United States Patent
Schellenberger et al.

(10) Patent No.: US 8,957,021 B2
(45) Date of Patent: *Feb. 17, 2015

(54) GLUCOSE-REGULATING POLYPEPTIDES AND METHODS OF MAKING AND USING SAME

(75) Inventors: Volker Schellenberger, Palo Alto, CA (US); Joshua Silverman, Sunnyvale, CA (US); Willem P. Stemmer, Los Gatos, CA (US); Chia-wei Wang, Milpitas, CA (US); Nathan Geething, Santa Clara, CA (US); Jeffrey L. Cleland, San Carlos, CA (US)

(73) Assignee: Amunix Operating Inc., Mountain View, CA (US)

( * ) Notice: Subject to any disclaimer, the term of this patent is extended or adjusted under 35 U.S.C. 154(b) by 774 days.

This patent is subject to a terminal disclaimer.

(21) Appl. No.: 12/796,650

(22) Filed: Jun. 8, 2010

(65) Prior Publication Data

US 2010/0323956 A1    Dec. 23, 2010

Related U.S. Application Data

(63) Continuation-in-part of application No. 12/699,761, filed on Feb. 3, 2010, now Pat. No. 8,673,860, which is a continuation-in-part of application No. PCT/US2010/023106, filed on Feb. 3, 2010.

(60) Provisional application No. 61/268,193, filed on Jun. 8, 2009, provisional application No. 61/236,836, filed on Aug. 25, 2009, provisional application No. 61/280,955, filed on Nov. 10, 2009.

(51) Int. Cl.
| | | |
|---|---|---|
| *A61K 38/00* | (2006.01) | |
| *C07K 19/00* | (2006.01) | |
| *A61P 3/10* | (2006.01) | |
| *C07K 14/605* | (2006.01) | |
| *C07K 14/575* | (2006.01) | |

(52) U.S. Cl.
CPC .............. *C07K 14/605* (2013.01); *C07K 14/575* (2013.01); *C07K 14/57563* (2013.01); *A61K 38/00* (2013.01); *C07K 2319/00* (2013.01); *C07K 2319/31* (2013.01)
USPC .............. 514/7.2; 514/6.8; 514/7.3; 530/350; 530/399; 435/69.7; 435/69.4

(58) Field of Classification Search
CPC ....... A61K 38/00; A61K 38/16; A61K 38/26; A61K 38/48; C07K 19/00; C07K 14/00; C07K 14/47; C07K 14/575; C07K 2316/00; C07K 2319/00; C07K 2319/31; C07K 2319/35
See application file for complete search history.

(56) References Cited

U.S. PATENT DOCUMENTS

| | | |
|---|---|---|
| 5,270,176 A | 12/1993 | Dorschug et al. |
| 5,554,730 A | 9/1996 | Woiszwillo et al. |
| 5,599,907 A | 2/1997 | Anderson et al. |
| 6,294,170 B1 | 9/2001 | Boone et al. |
| 6,733,753 B2 | 5/2004 | Boone et al. |
| 6,905,688 B2 | 6/2005 | Rosen et al. |
| 7,442,778 B2 | 10/2008 | Gegg et al. |
| 7,452,967 B2 | 11/2008 | Bertin |
| 7,528,242 B2 | 5/2009 | Anderson et al. |
| 7,846,455 B2 | 12/2010 | Collins et al. |
| 2003/0049689 A1 | 3/2003 | Edwards et al. |
| 2003/0181381 A1 | 9/2003 | Himmelspach et al. |
| 2003/0190740 A1 | 10/2003 | Altman |
| 2004/0043446 A1 | 3/2004 | DeFrees et al. |
| 2004/0259780 A1 | 12/2004 | Glasebrook et al. |
| 2005/0042721 A1 | 2/2005 | Fang et al. |
| 2005/0118136 A1 | 6/2005 | Leung et al. |
| 2005/0123997 A1 | 6/2005 | Lollar |
| 2005/0287153 A1 | 12/2005 | Dennis |
| 2006/0026719 A1 | 2/2006 | Kieliszewski et al. |
| 2006/0287220 A1 | 12/2006 | Li et al. |
| 2006/0293232 A1 | 12/2006 | Levy et al. |
| 2007/0048282 A1 | 3/2007 | Rosen et al. |
| 2007/0161087 A1 | 7/2007 | Glaesner et al. |
| 2007/0203058 A1 | 8/2007 | Lau et al. |
| 2007/0244301 A1 | 10/2007 | Siekmann et al. |
| 2008/0039341 A1 | 2/2008 | Schellenberger et al. |
| 2008/0167238 A1 | 7/2008 | Rosen et al. |
| 2008/0176288 A1 | 7/2008 | Leung et al. |

(Continued)

FOREIGN PATENT DOCUMENTS

| | | |
|---|---|---|
| CN | 1933855 | 3/2007 |
| WO | WO 97/33552 A1 | 9/1997 |

(Continued)

OTHER PUBLICATIONS

Altschul et al. Basic Local Alignment Search Tool. J. Mol. Biol. 1990; 215:403-410.
Alvarez, et al. Improving Protein Pharmacokinetics by Genetic Fusion to Simple Amino Acid Sequences. J Biol Chem. 2004; 279: 3375-81.
Arndt, et al. Factors influencing the dimer to monomer transition of an antibody single-chain Fv fragment. Biochemistry. 1998; 37(37):12918-26.
Ausubel, et al. eds. Current Protocols in Molecular Biology. Wiley. 1987.
Chou, et al. Prediction of Protein Conformation. Biochemistry. 1974; 13: 222-245.
Clark, et al. Long-acting growth hormones produced by conjugation with polyethylene glycol. J Biol Chem. 1996; 271(36):21969-77.

(Continued)

*Primary Examiner* — Karlheinz R Skowronek
*Assistant Examiner* — Catherine Mader
(74) *Attorney, Agent, or Firm* — Wilson Sonsini Goodrich & Rosati

(57) ABSTRACT

The present invention relates to compositions comprising glucose regulating peptides linked to extended recombinant polypeptide (XTEN), isolated nucleic acids encoding the compositions and vectors and host cells containing the same, and methods of making and using such compositions in treatment of glucose regulating peptide-related diseases, disorders, and conditions.

30 Claims, 30 Drawing Sheets

(56) References Cited

U.S. PATENT DOCUMENTS

| | | |
|---|---|---|
| 2008/0234193 A1 | 9/2008 | Bossard et al. |
| 2008/0260755 A1 | 10/2008 | Metzner et al. |
| 2008/0261877 A1 | 10/2008 | Ballance et al. |
| 2008/0269125 A1 | 10/2008 | Ballance et al. |
| 2008/0286808 A1 | 11/2008 | Schellenberger et al. |
| 2008/0312157 A1 | 12/2008 | Levy et al. |
| 2009/0042787 A1 | 2/2009 | Metzner et al. |
| 2009/0060862 A1 | 3/2009 | Chang et al. |
| 2009/0092582 A1 | 4/2009 | Bogin et al. |
| 2009/0239795 A1* | 9/2009 | Ballance et al. ............... 514/12 |
| 2010/0189682 A1 | 7/2010 | Schellenberger et al. |
| 2010/0239554 A1* | 9/2010 | Schellenberger et al. ... 424/94.3 |
| 2011/0151433 A1 | 6/2011 | Schellenberger et al. |

FOREIGN PATENT DOCUMENTS

| | | |
|---|---|---|
| WO | WO 9949901 A1 | 10/1999 |
| WO | WO 2005/025499 A2 | 3/2005 |
| WO | WO 2005/025499 A3 | 5/2005 |
| WO | WO 2006/081249 A2 | 8/2006 |
| WO | WO 2006/081249 A3 | 2/2007 |
| WO | WO 2007/090584 A1 | 8/2007 |
| WO | WO 2007/103455 A2 | 9/2007 |
| WO | WO 2007/103455 A3 | 11/2007 |
| WO | WO 2008/012629 A2 | 1/2008 |
| WO | WO 2008/049931 A1 | 5/2008 |
| WO | WO 2008/077616 A1 | 7/2008 |
| WO | WO 2008/155134 A1 | 12/2008 |
| WO | WO 2010/091122 A1 | 8/2010 |

OTHER PUBLICATIONS

Collen, et al. Polyethylene Glycol—Derivatized Cysteine-Substitution Variants of Recombinant Staphylokinase for Single-Bolus Treatment of Acute Myocardial Infarction. Circulation. 2000; 102: 1766-72.

D'Aquino, et al. The magnitude of the backbone conformational entropy change in protein folding. Proteins. 1996; 25: 143-56.

Deckert, et al. Pharmacokinetics and microdistribution of polyethylene glycolmodified humanized A33 antibody targeting colon cancer xenografts. Int J Cancer. 2000; 87: 382-90.

Dhalluin, et al. Structural and biophysical characterization of the 40 kDa PEG-interferon-alpha2a and its individual positional isomers. Bioconjug Chem. 2005; 16:504-17.

Ellis, et al. Valid and invalid implementations of GOR secondary structure predictions. Comput Appl Biosci. Jun. 1994;10(3):341-8. (Abstract only).

Greenwald, et al. Effective drug delivery by PEGylated drug conjugates. Adv Drug Deliv Rev. 2003; 55: 217-50.

Gustafsson, et al. Codon bias and heterologous protein expression. Trends Biotechnol. 2004; 22: 346-53.

Harris, et al. Effect of pegylation on pharmaceuticals. Nat Rev Drug Discov. 2003; 2: 214-21.

Hinds, et al. PEGylated insulin in PLGA microparticles. In vivo and in vitro analysis. J Control Release. Jun. 2, 2005;104(3):447-60.

Hopp, et al. Prediction of protein antigenic determinants from amino acid sequences. Proc Natl Acad Sci U S A 1981; 78, 3824, #3232.

International search report dated Oct. 29, 2010 for PCT Application No. US10/37855.

International search report dated Dec. 26, 2007 for PCT Application No. US2007/05952.

International search report dated Mar. 16, 2009 for PCT Application No. US2008/09787.

International search report dated Apr. 20, 2010 for PCT Application No. US 10-23106.

Kochendoerfer. Chemical and biological properties of polymer-modified proteins. Expert Opin Biol Ther. 2003; 3: 1253-61.

Kohn, et al. Random-coil behavior and the dimensions of chemically unfolded proteins. Proc Natl Acad Sci U S A. Aug. 24, 2004;101(34):12491-6.

Kornblatt, et al. Cross-linking of cytochrome oxidase subunits with difluorodinitrobenzene. Can J. Biochem. 1980; 58: 219-224.

Kubetzko, et al. Protein PEGylation decreases observed target association rates via a dual blocking mechanism. Mol Pharmacol. 2005; 68: 1439-54.

Levitt. A simplified representation of protein conformations for rapid simulation of protein folding. J Mol Biol 1976; 104, 59-107.

McPherson, et al. eds. PCR 2: a practical approach. Oxford University Press. 1995.

Mitraki, et al. Protein Folding Intermediates and Inclusion Body Formation. Bio/Technology. 1989; 7:690-697.

Oslo, ed. Remington's Pharmaceutical Sciences. 16th edition. 1980.

Pepinsky, et al. Improved pharmacokinetic properties of a polyethylene glycol-modified form of interferon-beta-1a with preserved in vitro bioactivity. J Pharmacol Exp Ther. 2001; 297: 1059-66.

Sambrook, et al. Molecular Cloning: A Laboratory Manual, 2nd Edition; Current Protocols in Molecular Biology. 1989.

Singh, et al. ProPred: Prediction of HLA-DR binding sites. Bioinformatics. 2001; 17: 1236-1237.

Smith, et al. Single-step purification of polypeptides expressed in Escherichia coli as fusions with glutathione S-transferase. Gene. 1988; 67(1):31-40.

Stickler, et al. Human population-based identification of CD4(+) T-cell peptide epitope determinants. J Immunol Methods. 2003; 281: 95-108.

Stites, et al. Empirical evaluation of the influence of side chains on the conformational entropy of the polypeptide backbone. Proteins. 1995; 22: 132-140.

Sturniolo, et al. Generation of tissue-specific and promiscuous HLA ligand databases using DNA microarrays and virtual HLA class II matrices. Natural Biotechnol. 1999; 17: 555-561.

Venkatachalam, et al. Conformation of polypeptide chains. Annu Rev Biocheim 1969; 38: 45-82.

Yang, et al. Tailoring structure-function and pharmacokinetic properties of single-chain Fv proteins by site-specific PEGylation. Protein Eng. 2003; 16: 761-70.

Yankai, et al. Ten tandem repeats of beta-hCG 109-118 enhance immunogenicity and anti-tumor effects of beta-hCG C-terminal peptide carried by mycobacterial heat-shock protein HSP65. Biochem Biophys Res Commun. 2006; 345(4):1365-71.

Buscaglia, et al. Tandem amino acid repeats from Trypanosoma cruzi shed antigens increase the half-life of proteins in blood. Blood. Mar. 15, 1999;93(6):2025-32.

International search report dated Jul. 12, 2011 for PCT Application No. US20/61590.

Uversky, et al. Why are "natively unfolded" proteins unstructured under physiologic conditions? Proteins. Nov. 15, 2000;41(3):415-27.

Walker, et al. Using protein-based motifs to stabilize peptides. J Pept Res. Nov. 2003;62(5):214-26.

Wright, et al. Intrinsically unstructured proteins: re-assessing the protein structure-function paradigm. J Mol Biol. Oct. 22, 1999;293(2):321-31.

International search report and written opinion dated Dec. 20, 2010 for PCT Application No. US10/02147.

Schellenberger, et al. A recombinant polypeptide extends the in vivo half-life of peptides and proteins in a tunable manner. Nat Biotechnol. Dec. 2009;27(12):1186-92.

European search report and search opinion dated Jan. 27, 2011 for Application No. 08795371.7.

Cleland, et al. An Extended Half-Life Glucagon Construct for the Prevention of Nocturnal Hypoglycemia. In Diabetes. 2009; 58:A513.

Cleland, et al. A Monthly Dosed GLP-1 Analog for Treatment of Type 2 Diabetes Mellitus. Diabetes, 2010; 59(1):A104. 70th Annual Meeting of the American Diabetes Association, Orland, FL, USA 2010.

Cleland, et al. An extended half-life exenatide construct for weekly administration in the treatment of diabetes mellitus. In Diabetes, vol. 58, pp. A511-A512. 1701 N Beauregard St, Alexandria, VA 22311-1717 USA: Amer Diabetes Assoc, 2009. Abstract only.

(56) References Cited

OTHER PUBLICATIONS

Geething, et al. Geg-XTEN: an improved glucagon capable of preventing hypoglycemia without increasing baseline blood glucose. PLoS One. Apr. 14, 2010;5(4):e10175. doi: 10.1371/journal.pone.0010175.

Huang, et al. Preparation and characterization of a novel exendin-4 human serum albumin fusion protein expressed in *Pichia pastoris*. J Pept Sci. May 2008;14(5):588-95.

Kyngas, et al. Unreliability of the Chou-Fasman parameters in predicting protein secondary structure. Protein Eng. May 1998;11(5):345-8.

Lee, et al. Synthesis, characterization, and pharmacokinetic studies of PEGylated glucagon-like peptide-1. Bioconjug Chem. Mar.-Apr. 2005; 16(2):377-82.

Zhou, et al. Preparation and PEGylation of exendin-4 peptide secreted from yeast *Pichia pastoris*. Eur J Pharm Biopharm. Jun. 2009; 72(2):412-7.

* cited by examiner

A.
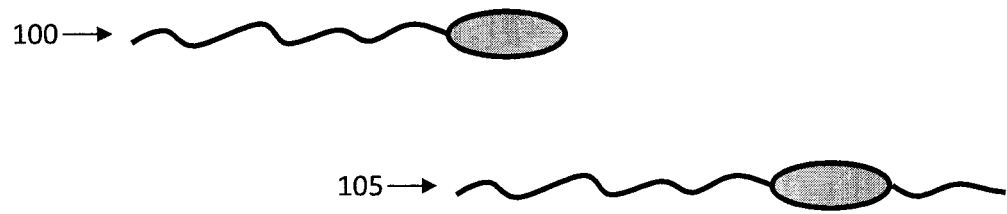
B.
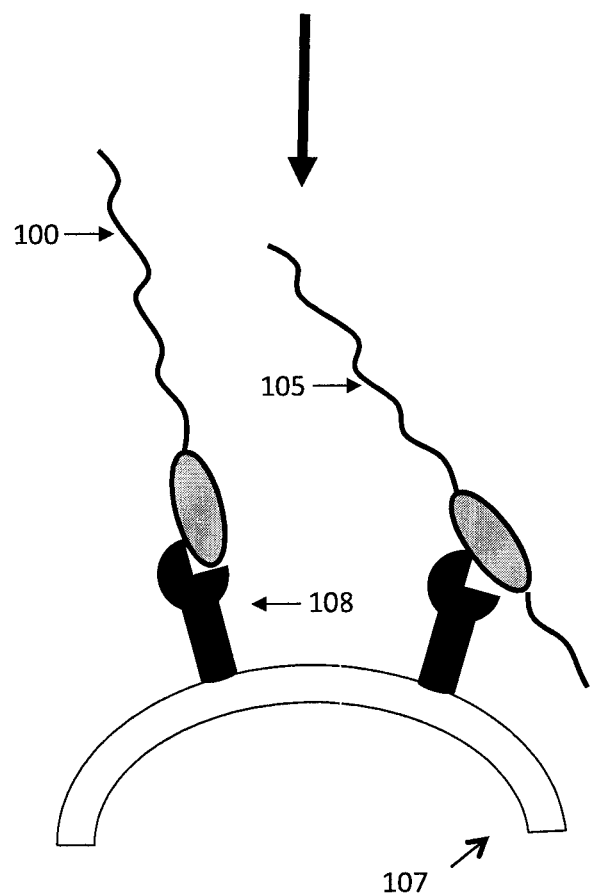
FIG. 3

```
LCW0569  ATGGCTNNNNNNNNGCTGGCTCTCCAACCTCCACTGAGGAAGGT
         M   A   X   X   A   G   S   P   T   S   T   E   E
LCW0570  ATGGCTNNNNNNNNGAAAGCGCAACCCCTGAGTCCGGTCCAGGT
         M   A   X   X   E   S   A   T   P   E   S   G   P
LCW0571  ATGGCTNNNNNNNNACTCCGTCTGGTGCTACCGGTTCCCCAGGT
         M   A   X   X   T   P   S   G   A   T   G   S   P
```

| X = APST, | GS | or | GE |
|---|---|---|---|
| TCAG/C/TCAG, | AG/G/TC | or | G/AG/AG |
| Diversity: 16 | 4 | | 4 |

- Batch 2 libraries are based on 3 best clones from batch 1 screening.
- All 24 codons for 6 amino acids G,E,S,P,A,T are included.
- Each new library is composed of 3x3=9 pairs of annealed oligos.

FIG. 10

1. Glucagon-Y288
2. Glucagon-Y144
3. Glucagon-Y72
4. Glucagon-Y36
- - - - = Standards 1. Glucagon-Y288  0.2 mg/kg subcutanously
2. Glucagon-Y144  0.2 mg/kg subcutanously
3. Glucagon-Y72   0.2 mg/kg subcutanously

US 8,957,021 B2

GLUCOSE-REGULATING POLYPEPTIDES AND METHODS OF MAKING AND USING SAME

CROSS-REFERENCE TO RELATED APPLICATIONS

This application is a continuation-in-part of U.S. application Ser. No. 12/699,761, filed Feb. 3, 2010, which in turn claims the priority benefit of U.S. Provisional Application Ser. No. 61/149,669, filed Feb. 3, 2009, 61/185,112, filed Jun. 8, 2009, 61/268,193, filed Jun. 8, 2009, 61/236,493, filed Aug. 24, 2009, 61/236,836, filed Aug. 25, 2009, 61/243,707, filed Sep. 18, 2009, 61/245,490, filed Sep. 24, 2009, 61/280,955, filed Nov. 10, 2009, 61/280,956, filed Nov. 10, 2009, and 61/281,109, filed Nov. 12, 2009. This application also claims the priority benefit of U.S. Provisional Application Ser. No. 61/268,193, filed Jun. 8, 2009, 61/236,836, filed Aug. 25, 2009, 61/280,955, filed Nov. 10, 2009 and PCT Application Serial No. PCT/US10/23106, filed Feb. 3, 2010, all of which are hereby incorporated herein by reference in their entirety.

STATEMENT REGARDING FEDERALLY SPONSORED RESEARCH

This invention was made with government support under SBIR grant 2R44GM079873-02 awarded by the National Institutes of Health. The government has certain rights in the invention.

SEQUENCE LISTING

The instant application contains a Sequence Listing which has been submitted via EFS-Web and is hereby incorporated by reference in its entirety. Said ASCII copy, created on Jul. 28, 2010, is named 32887122.txt and is 3,692,063 bytes in size.

BACKGROUND OF THE INVENTION

Glucose-regulating peptides are critical regulatory components of human metabolism. Various peptides have been described with biological effects that result in either an increase or decrease in serum glucose levels. These peptides tend to be highly homologous to each other, even when they possess opposite biological functions. Many glucose regulating peptides, including those used as therapeutics, are typically labile molecules exhibiting short shelf-lives, particularly when formulated in aqueous solutions. In addition, many glucose regulating peptides have limited solubility, or become aggregated during recombinant productions, requiring complex solubilization and refolding procedures. Various chemical polymers can be attached to such peptides and proteins to modify their properties. Of particular interest are hydrophilic polymers that have flexible conformations and are well hydrated in aqueous solutions. A frequently used polymer is polyethylene glycol (PEG). These polymers tend to have large hydrodynamic radii relative to their molecular weight (Kubetzko, S., et al. (2005) Mol Pharmacol, 68: 1439-54), and can result in enhanced pharmacokinetic properties. However, the chemical conjugation of polymers to proteins requires complex multi-step processes; typically, the protein component needs to be produced and purified prior to the chemical conjugation step and the conjugation step can result in the formation of heterogeneous product mixtures that need to be separated, leading to significant product loss. Alternatively, such mixtures can be used as the final pharmaceutical product, but are difficult to standardize. Some examples are currently marketed PEGylated Interferon-alpha products that are used as mixtures (Wang, B. L., et al. (1998) J Submicrosc Cytol Pathol, 30: 503-9; Dhalluin, C., et al. (2005) Bioconjug Chem, 16: 504-17). Such mixtures are difficult to reproducibly manufacture and characterize as they contain isomers with reduced or no therapeutic activity.

Albumin and immunoglobulin fragments such as Fc regions have been used to conjugate other biologically active proteins, with unpredictable outcomes with respect to increases in half-life or immunogenicity. Unfortunately, the Fc domain does not fold efficiently during recombinant expression and tends to form insoluble precipitates known as inclusion bodies. These inclusion bodies must be solubilized and functional protein must be renatured. This is a time-consuming, inefficient, and expensive process that requires additional manufacturing steps and often complex purification procedures.

Thus, there remains a significant need for compositions and methods that would improve the biological, pharmacological, safety, and/or pharmaceutical properties of glucose regulating peptides.

SUMMARY OF THE INVENTION

The present disclosure is directed to compositions and methods that can be useful for or the treatment of any disease, disorder or condition that is improved, ameliorated, or inhibited by the administration of a glucose regulating peptide. In particular, the present invention provides compositions of fusion proteins comprising one or more extended recombinant polypeptides with a non-repetitive sequence and/or unstructured conformation (XTEN) linked to glucose regulating peptide (GP). In part, the present disclosure is directed to pharmaceutical compositions comprising the fusion proteins and the uses thereof for treating glucose regulating peptide-related diseases, disorders or conditions.

In one embodiment, the invention provides an isolated fusion protein, comprising a glucose regulating peptide that is at least about 90%, or about 95%, or about 96%, or about 97%, or about 98%, or about 99% identical to an amino acid sequence selected from Table 1, wherein said glucose regulating peptide is linked to an extended recombinant polypeptide (XTEN) of at least about 100, or at least about 200, or at least about 400, or at least about 800, or at least about 900, or at least about 1000, or at least about 2000, up to about 3000 amino acids residues, wherein the XTEN is characterized in that (a) the XTEN comprises at least about 200 contiguous amino acids that exhibits at least about 90%, or about 95%, or about 96%, or about 97%, or about 98%, or about 99% identical to a comparable length of an amino acid sequence selected from a sequence shown in Table 5; (b) the XTEN sequence lacks a predicted T-cell epitope when analyzed by TEPITOPE algorithm, wherein the TEPITOPE algorithm prediction for epitopes within the XTEN sequence is based on a score of −5, or −6, or −7, or −8, or −9 or greater; (c) the XTEN has a subsequence score of less than 10, or less than 9, or less than 8, or less than 7, or less than 6, or less than 5, or even less; and (d) the sum of glycine (G), alanine (A), serine (S), threonine (T), glutamate (E) and proline (P) residues constitutes more than about 90%, or about 95%, or about 96%, or about 97%, or about 98%, or about 99% of the total amino acid residues of the XTEN. In one embodiment, the glucose regulating peptide of the isolated fusion protein is human glucose regulating peptide. In another embodiment, the isolated fusion protein comprises at least a second XTEN, wherein the fusion protein adopts a multiple-XTEN configuration shown in Table 5, or a variant thereof.

In another embodiment, the XTEN sequence of the GPXTEN fusion proteins is characterized in that is has greater than 90% random coil formation, or about 95%, or about 96%, or about 97%, or about 98%, or about 99% random coil formation as determined by GOR algorithm; and the XTEN sequence has less than 2% alpha helices and 2% beta-sheets as determined by the Chou-Fasman algorithm.

In another embodiment, the invention provides GPXTEN fusion proteins, wherein the XTEN is characterized in that the sum of asparagine and glutamine residues is less than 10% of the total amino acid sequence of the XTEN, the sum of methionine and tryptophan residues is less than 2% of the total amino acid sequence of the XTEN, the XTEN sequence has less than 5% amino acid residues with a positive charge, the XTEN sequence has greater than 90% random coil formation, or about 95%, or about 96%, or about 97%, or about 98%, or about 99% random coil formation as determined by GOR algorithm; and the XTEN sequence has less than 2% alpha helices and 2% beta-sheets as determined by the Chou-Fasman algorithm.

In another embodiment, the invention provides GPXTEN fusion proteins, wherein the XTEN is characterized in that at least about 80%, or at least about 90%, or at least about 91%, or at least about 92%, or at least about 93%, or at least about 94%, or at least about 95%, or at least about 96%, or at least about 97%, or at least about 98%, or at least about 99% of the XTEN sequence consists of non-overlapping sequence motifs wherein each of the sequence motifs has about 9 to about 14 amino acid residues and wherein the sequence of any two contiguous amino acid residues does not occur more than twice in each of the sequence motifs the sequence motifs consist of four to six types of amino acids selected from glycine (G), alanine (A), serine (S), threonine (T), glutamate (E) and proline (P).

In some embodiments, no one type of amino acid constitutes more than 30% of the XTEN sequence of the GPXTEN. In other embodiments, the XTEN has a sequence in which no three contiguous amino acids are identical unless the amino acid is serine, in which case no more than three contiguous amino acids are serine residues. In still other embodiments, at least about 80%, or about 90%, or about 95%, or about 96%, or about 97%, or about 98%, or about 99%, or 100% of the XTEN sequence consists of non-overlapping sequence motifs, wherein each of the sequence motifs has 12 amino acid residues. In one embodiment, the XTEN sequence consists of non-overlapping sequence motifs, wherein the sequence motifs are from one or more sequences of Table 2.

In some embodiments, GPXTEN fusion proteins exhibits enhanced pharmacokinetic properties compared to GP not linked to XTEN, wherein the enhanced properties include but are not limited to longer terminal half-life, larger area under the curve, increased time in which the blood concentration remains within the therapeutic window, increased time between consecutive doses, and decreased dose in moles over time. In some embodiments, the terminal half-life of the GPXTEN fusion protein administered to a subject is increased at least about two fold, or at least about three-fold, or at least about four-fold, or at least about five-fold, or at least about six-fold, or at least about eight-fold, or at least about ten-fold, or at least about 20-fold, or at least about 40-fold, or at least about 60-fold, or at least about 100-fold compared to GP not linked to XTEN and administered to a subject at a comparable dose. In other embodiments, the enhanced pharmacokinetic property is reflected by the fact that the blood concentrations that remain within the therapeutic window for the GPXTEN fusion protein for a given period are at least about two fold, or at least about three-fold, or at least about four-fold, or at least about five-fold, or at least about six-fold, or at least about eight-fold, or at least about ten-fold longer, or at least about 20-fold, or at least about 40-fold, or at least about 60-fold, or at least about 100-fold, or ever higher as compared to GP not linked to XTEN and administered to a subject at a comparable dose. The increase in half-life and time spent within the therapeutic window permits less frequent dosing and decreased amounts of the fusion protein (in moles equivalent) that are administered to a subject, compared to the corresponding GP not linked to XTEN. In one embodiment, the therapeutically effective dose regimen results in a gain in time of at least two-fold, or at least three-fold, or at least four-fold, or at least five-fold, or at least six-fold, or at least eight-fold, or at least 10-fold, or at least about 20-fold, or at least about 40-fold, or at least about 60-fold, or at least about 100-fold between at least two consecutive $C_{max}$ peaks and/or $C_{min}$ troughs for blood levels of the fusion protein compared to the corresponding GP not linked to the fusion protein and administered using a comparable dose regimen to a subject.

In some embodiments, the XTEN enhances thermostability of a biologically active protein when linked to the biologically active protein wherein the thermostability is ascertained by measuring the retention of biological activity after exposure to a temperature of about 37° C. for at least about 7 days of the biologically active protein in comparison to the XTEN linked to the biologically active protein. In one embodiment of the foregoing, the retention of biological activity in increased by at least about 50%, at least about 60%, at least about 70%, at least about 80%, at least about 90%, at least about 100%, or about 150%, at least about 200%, at least about 300%, or about 500% longer compared to the GP not linked to the XTEN comprises of the XTEN.

In some embodiments, the isolated fusion protein with at least a first XTEN comprises a GP wherein the GP is human glucose regulating peptide. In some embodiments, the isolated fusion protein further comprises a second XTEN, which can be identical or can be different from the first XTEN, and wherein the fusion protein adopts a multiple-XTEN configuration shown in Table 7. In one embodiment of the foregoing, the first and the second XTEN can each be a sequence selected from Table 5, or can exhibit at least at least about 80%, or at least about 90%, or at least about 91%, or at least about 92%, or at least about 93%, or at least about 94%, or at least about 95%, or at least about 96%, or at least about 97%, or at least about 98%, or at least about 99% or 100% sequence identity to a sequence selected from Table 5. In another embodiment, the isolated fusion protein comprising a second XTEN sequence adopts a multiple-XTEN configuration shown in Table 7.

In one embodiment, the isolated fusion protein is less immunogenic compared to the GP not linked to the XTEN, wherein immunogenicity is ascertained by, e.g., measuring production of IgG antibodies selectively binding to the biologically active protein after administration of comparable doses to a subject.

In some embodiments, the glucose regulating peptide and the XTEN of the fusion protein is linked via a spacer, wherein the spacer sequence comprises between about 1 to about 50 amino acid residues that optionally comprises a cleavage sequence. In one embodiment, the cleavage sequence is susceptible to cleavage by a protease. Non-limiting examples of such protease include FXIa, FXIIa, kallikrein, FVIIa, FIXa, FXa, thrombin, elastase-2, granzyme B, MMP-12, MMP-13, MMP-17 or MMP-20, TEV, enterokinase, rhinovirus 3C protease, and sortase A.

In some embodiments, the isolated fusion protein is configured to have reduced binding affinity for a target receptor of the corresponding GP, as compared to the corresponding GP not linked to the fusion protein. In one embodiment, the GPXTEN fusion protein exhibits binding affinity for a target receptor of the GP in the range of about 0.01%-30%, or about 0.1% to about 20%, or about 1% to about 15%, or about 2% to about 10% of the binding affinity of the corresponding GP that lacks the XTEN. In another embodiment, the GPXTEN fusion protein exhibits binding affinity for a target receptor of the GP that is reduced at least about 3-fold, or at least about 5-fold, or at least about 6-fold, or at least about 7-fold, or at least about 8-fold, or at least about 9-fold, or at least about 10-fold, or at least about 12-fold, or at least about 15-fold, or at least about 17-fold, or at least about 20-fold, or at least about 30-fold, or at least about 50-fold, or at least about 100-fold less binding affinity compared to GP not linked to XTEN. In a related embodiment, a fusion protein with reduced affinity can have reduced receptor-mediated clearance and a corresponding increase in half-life of at least about 3-fold, or at least about 5-fold, or at least about 6-fold, or at least about 7-fold, or at least about 8-fold, or at least about 9-fold, or at least about 10-fold, or at least about 12-fold, or at least about 15-fold, or at least about 17-fold, or at least about 20-fold, or at least about 30-fold, or at least about 50-fold, or at least about 100-fold longer compared to the corresponding GP that is not linked to the fusion protein.

In one embodiment, the invention provides an isolated GPXTEN fusion protein comprising an amino acids sequence that has at least about 80%, or at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from Table 35, Table 36, and Table 37.

In some embodiments, the invention provides GPXTEN fusion proteins wherein the GPXTEN exhibits increased solubility of at least three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least 40-fold, or at least 60-fold at physiologic conditions compared to the GP not linked to the fusion protein.

In some embodiments, GPXTEN fusion proteins exhibit an increased apparent molecular weight as determined by size exclusion chromatography, compared to the actual molecular weight, wherein the apparent molecular weight is at least about 100 kD, or at least about 150 kD, or at least about 200 kD, or at least about 300 kD, or at least about 400 kD, or at least about 500 kD, or at least about 600 kD, or at least about 700 kD, while the actual molecular weight of each GP component of the fusion protein is less than about 25 kD. Accordingly, the GPXTEN fusion proteins can have an Apparent Molecular Weight that is about 4-fold greater, or about 5-fold greater, or about 6-fold greater, or about 7-fold greater, or about 8-fold greater than the actual molecular weight of the fusion protein. In some cases, the isolated GPXTEN fusion protein of the foregoing embodiments exhibits an apparent molecular weight factor under physiologic conditions that is greater than about 4, or about 5, or about 6, or about 7, or about 8.

The invention contemplates GPXTEN fusion proteins compositions comprising, but not limited to GP selected from Table 1 (or fragments or sequence variants thereof), XTEN selected from Table 5 (or sequence variants thereof) that are in a configuration selected from Table 5. Generally, the resulting GPXTEN will retain at least a portion of the biological activity of the corresponding GP not linked to the XTEN. In other cases, the GP component either becomes biologically active or has an increase in activity upon its release from the XTEN by cleavage of an optional cleavage sequence incorporated within spacer sequences into the GPXTEN.

In one embodiment of the GPXTEN composition, the invention provides a fusion protein of formula I:

$(XTEN)_x\text{-GP-}(XTEN)_y$      I wherein independently for each occurrence, GP is a is a glucose regulating peptide; x is either 0 or 1 and y is either 0 or 1 wherein x+y≤1; and XTEN is an extended recombinant polypeptide.

In some embodiments, the XTEN is fused to the glucose regulating peptide on an N- or C-terminus of the glucose regulating peptide. In some embodiments, the isolated fusion protein comprises a human glucose regulating peptide and a first and a second XTEN selected from AE912, AM923, AE144, and AE288.

In another embodiment of the GPXTEN composition, the invention provides a fusion protein of formula II:

$(XTEN)_x\text{-}(GP)\text{-}(S)_y\text{-}(XTEN)_y$      II wherein independently for each occurrence, GP is a is a glucose regulating peptide; S is a spacer sequence having between 1 to about 50 amino acid residues that can optionally include a cleavage sequence; x is either 0 or 1 and y is either 0 or 1 wherein x+y≤1; and XTEN is an extended recombinant polypeptide.

In another embodiment, the invention provides an isolated fusion protein, wherein the fusion protein is of formula III:

$(GP)\text{-}(S)_x\text{-}(XTEN)\text{-}(S)_y\text{-}(GP)\text{-}(S)_z\text{-}(XTEN)_z$      III wherein independently for each occurrence, GP is a is a glucose regulating peptide; S is a spacer sequence having between 1 to about 50 amino acid residues that can optionally include a cleavage sequence; x is either 0 or 1; y is either 0 or 1; z is either 0 or 1; and XTEN is an extended recombinant polypeptide.

In another embodiment, the invention provides an isolated fusion protein, wherein the fusion protein is of formula IV:

$(XTEN)_x\text{-}(S)_y\text{-}(GP)\text{-}(S)_z\text{-}(XTEN)\text{-}(GP)$      IV wherein independently for each occurrence, GP is a is a glucose regulating peptide; S is a spacer sequence having between 1 to about 50 amino acid residues that can optionally include a cleavage sequence; x is either 0 or 1; y is either 0 or 1; z is either 0 or 1; and XTEN is an extended recombinant polypeptide.

In another embodiment, the invention provides an isolated fusion glucose regulating peptide, wherein the fusion protein is of formula V:

$(GP)_x\text{-}(S)_x\text{-}(GP)\text{-}(S)_y\text{-}(XTEN)$      V wherein independently for each occurrence, GP is a is a glucose regulating peptide; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VI:

$(XTEN)\text{-}(S)_x\text{-}(GP)\text{-}(S)_y\text{-}(GP)$      VI wherein independently for each occurrence, GP is a is a glucose regulating peptide; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VII:

(XTEN)-(S)$_x$-(GP)-(S)$_y$-(GP)-(XTEN)   VII wherein independently for each occurrence, GP is a is a glucose regulating peptide; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VIII:

((S)$_m$-(GP)$_x$-(S)$_n$-(XTEN)$_y$-(S)$_o$)$_t$   VIII wherein t is an integer that is greater than 0 (1, 2, 3, etc.); independently each of m, n, o, x, and y is an integer (0, 1, 2, 3, etc.), GP is a is a glucose regulating peptide; S is an spacer, optionally comprising a cleavage site; and XTEN is an extended recombinant polypeptide, with the proviso that: (1) x+y>1, (2) when t=1, x>0 and y>0, (3) when there is more than one GP, S, or XTEN, each GP, XTEN, or S are the same or are independently different; and (4) when t>1, each m, n, o, x, or y within each subunit are the same or are independently different.

In some embodiments, administration of a therapeutically effective dose of a fusion protein of an embodiment of formulas I-VIII to a subject in need thereof can result in a gain in time of at least two-fold, or at least three-fold, or at least four-fold, or at least five-fold or more spent within a therapeutic window for the fusion protein compared to the corresponding GP not linked to the XTEN of and administered at a comparable dose to a subject. In other cases, administration of a therapeutically effective dose of a fusion protein of an embodiment of formulas I-VIII to a subject in need thereof can result in a gain in time between consecutive doses necessary to maintain a therapeutically effective dose regimen of at least 48 h, or at least 72 h, or at least about 96 h, or at least about 120 h, or at least about 7 days, or at least about 14 days, or at least about 21 days between consecutive doses compared to a GP not linked to XTEN and administered at a comparable dose.

The fusion proteins can be designed to have different configurations, N- to C-terminus, of a GP, XTEN, and optional spacer sequences, including but not limited to XTEN-GP, GP-XTEN, XTEN-S-GP, GP-S-XTEN, XTEN-GP-XTEN, GP-GP-XTEN, XTEN-GP-GP, GP-S-GP-XTEN, XTEN-GP-S-GP, and multimers thereof, or be of a configuration shown in Table 7. The choice of configuration can, as disclosed herein, confer particular pharmacokinetic, physicochemical, or pharmacologic properties.

In some embodiments, the isolated fusion protein is characterized in that: (i) it has a longer half-life compared to the corresponding glucose regulating peptide that lacks the XTEN; (ii) when a smaller molar amount of the fusion protein is administered to a subject in comparison to the corresponding glucose regulating peptide that lacks the XTEN administered to a subject under an otherwise equivalent dose regimen, the fusion protein achieves a comparable area under the curve (AUC) as the corresponding glucose regulating peptide that lacks the XTEN; (iii) when a smaller molar amount of the fusion protein is administered to a subject in comparison to the corresponding glucose regulating peptide that lacks the XTEN administered to a subject under an otherwise equivalent dose regimen, the fusion protein achieves a comparable therapeutic effect as the corresponding glucose regulating peptide that lacks the XTEN; (iv) when the fusion protein is administered to a subject less frequently in comparison to the corresponding glucose regulating peptide that lacks the XTEN administered to a subject using an otherwise equivalent molar amount, the fusion protein achieves a comparable area under the curve (AUC) as the corresponding glucose regulating peptide that lacks the XTEN; (v) when the fusion protein is administered to a subject less frequently in comparison to the corresponding glucose regulating peptide that lacks the XTEN administered to a subject using an otherwise equivalent molar amount, the fusion protein achieves a comparable therapeutic effect as the corresponding glucose regulating peptide that lacks the XTEN; (vi) when an accumulatively smaller molar amount of the fusion protein is administered to a subject in comparison to the corresponding glucose regulating peptide that lacks the XTEN administered to a subject under an otherwise equivalent dose period, the fusion protein achieves comparable area under the curve (AUC) as the corresponding glucose regulating peptide that lacks the XTEN; or (vii) when an accumulatively smaller molar amount of the fusion protein is administered to a subject in comparison to the corresponding glucose regulating peptide that lacks the XTEN administered to a subject under an otherwise equivalent dose period, the fusion protein achieves comparable therapeutic effect as the corresponding glucose regulating peptide that lacks the XTEN.

In one embodiment, the GPXTEN fusion proteins of formulas I-VIII described above exhibit a biological activity of at least about 0.1%, or at least about 1%, or at least about 2%, or at least about 3%, or at least about 4%, or at least about 5%, or at least about 10%, or at least about 20%, or at least about 30%, or at least 40%, or at least about 50%, or at least about 60%, or at least about 70%, or at least about 80%, or at least about 90%, or at least about 95% of the biological activity compared to the GP not linked to the fusion protein. In another embodiment, the GPXTEN fusion proteins of formulas I-VIII bind the same receptors as the corresponding parental GP that is not covalently linked to the fusion protein.

The invention provides a method of producing a fusion protein comprising a glucose regulating peptide fused to one or more extended recombinant polypeptides (XTEN), comprising: (a) providing host cell comprising a recombinant polynucleotide molecule encoding the fusion protein (b) culturing the host cell under conditions permitting the expression of the fusion protein; and (c) recovering the fusion protein. In one embodiment of the method, the glucose regulating peptide of the fusion protein has at least 90% sequence identity to human glucose regulating peptide or a sequence selected from Table 1. In another embodiment of the method, the one or more XTEN of the expressed fusion protein has at least about 90%, or about 91%, or about 92%, or about 93%, or about 94%, or about 95%, or about 96%, or about 97%, or about 98%, or about 99% to about 100% sequence identity to a sequence selected from Table 5. In another embodiment of the method, the polynucleotide encoding the XTEN is codon optimized for enhanced expression of said fusion protein in the host cell. In another embodiment of the method, the host cell is a prokaryotic cell. In another embodiment of the method, the host cell is E. coli. In another embodiment of the method the isolated fusion protein is recovered from the host cell cytoplasm in substantially soluble form.

The invention provides isolated nucleic acids comprising a polynucleotide sequence selected from (a) a polynucleotide encoding the fusion protein of any of the foregoing embodiments, or (b) the complement of the polynucleotide of (a). In one embodiment, the invention provides an isolated nucleic acid comprising a polynucleotide sequence that has at least 80% sequence identity, or about 85%, or at least about 90%, or about 91%, or about 92%, or about 93%, or about 94%, or about 95%, or about 96%, or about 97%, or about 98%, or about 99% to about 100% sequence identity to (a) a polynucleotide sequence of comparable length selected from Table 35, Table 36, and Table 37; or (b) the complement of the polynucleotide of (a). The invention provides expression vectors comprising the nucleic acid of any of the embodiments hereinabove described in this paragraph. In one embodiment, the expression vector of the foregoing further comprises a recombinant regulatory sequence operably linked to the polynucleotide sequence. In another embodiment, the polynucleotide sequence of the expression vectors of the foregoing is fused in frame to a polynucleotide encoding a secretion signal sequence, which can be a prokaryotic signal sequence. In one embodiment, the secretion signal sequence is selected from OmpA, DsbA, and PhoA signal sequences.

The invention provides a host cell, which can comprise an expression vector disclosed in the foregoing paragraph. In one embodiment, the host cell is a prokaryotic cell. In another embodiment, the host cell is *E. coli*. In another embodiment, the host cell is a eukaryotic cell.

In one embodiment, the invention provides pharmaceutical compositions comprising the fusion protein of any of the foregoing embodiments and a pharmaceutically acceptable carrier. In another embodiment, the invention provides kits, comprising packaging material and at least a first container comprising the pharmaceutical composition of the foregoing embodiment and a label identifying the pharmaceutical composition and storage and handling conditions, and a sheet of instructions for the reconstitution and/or administration of the pharmaceutical compositions to a subject.

The invention provides a method of treating a glucose regulating peptide-related condition in a subject, comprising administering to the subject a therapeutically effective amount of the fusion protein of any of the foregoing embodiments. In one embodiment of the method, the glucose regulating peptide-related condition is selected from, but not limited to, juvenile diabetes, type I diabetes, type II diabetes, obesity, acute hypoglycemia, acute hyperglycemia, nocturnal hypoglycemia, chronic hyperglycemia, glucagonomas, secretory disorders of the airway, arthritis, osteoporosis, central nervous system disease, restenosis, neurodegenerative disease, renal failure, congestive heart failure, nephrotic syndrome, cirrhosis, pulmonary edema, hypertension, and disorders wherein the reduction of food intake is desired, stroke, irritable bowel syndrome, myocardial infarction (e.g., reducing the morbidity and/or mortality associated therewith), stroke, acute coronary syndrome (e.g., characterized by an absence of Q-wave) myocardial infarction, post-surgical catabolic changes, hibernating myocardium or diabetic cardiomyopathy, insufficient urinary sodium excretion, excessive urinary potassium concentration, conditions or disorders associated with toxic hypervolemia, (e.g., renal failure, congestive heart failure, nephrotic syndrome, cirrhosis, pulmonary edema, and hypertension), polycystic ovary syndrome, respiratory distress, nephropathy, left ventricular systolic dysfunction, (e.g., with abnormal left ventricular ejection fraction), gastrointestinal disorders such as diarrhea, postoperative dumping syndrome and irritable bowel syndrome, (i.e., via inhibition of antro-duodenal motility), critical illness polyneuropathy (CIPN), dyslipidemia, organ tissue injury caused by reperfusion of blood flow following ischemia, and coronary heart disease risk factor (CHDRF) syndrome, and any other indication for which the unmodified glucose-regulating peptide (e.g. exendin-4, GLP-1 or glucagon) is utilized, or any other indication for which GP can be utilized (but for which endogenous glucose regulating peptide levels in a subject are not necessarily deficient).

In some embodiments, the composition can be administered subcutaneously, intramuscularly, or intravenously. In one embodiment, the composition is administered at a therapeutically effective amount. In one embodiment, the therapeutically effective amount results in a gain in time spent within a therapeutic window for the fusion protein compared to the corresponding GP of the fusion protein not linked to the fusion protein and administered at a comparable dose to a subject. The gain in time spent within the therapeutic window can at least three-fold longer than the corresponding GP not linked to the fusion protein, or alternatively, at least four-fold, or five-fold, or six-fold, or seven-fold, or eight-fold, or nine-fold, or at least 10-fold, or at least 20-fold, or at least about 30-fold, or at least about 50-fold, or at least about 100-fold longer than the corresponding GP not linked to the fusion protein. In some embodiments of the method of treatment, (i) a smaller molar amount of (e.g. of about two-fold less, or about three-fold less, or about four-fold less, or about five-fold less, or about six-fold less, or about eight-fold less, or about 100 fold-less or greater) the fusion protein is administered in comparison to the corresponding glucose regulating peptide that lacks the XTEN under an otherwise same dose regimen, and the fusion protein achieves a comparable area under the curve and/or a comparable therapeutic effect as the corresponding glucose regulating peptide that lacks the XTEN; (ii) the fusion protein is administered less frequently (e.g., every two days, about every seven days, about every 14 days, about every 21 days, or about, monthly) in comparison to the corresponding glucose regulating peptide that lacks the XTEN under an otherwise same dose amount, and the fusion protein achieves a comparable area under the curve and/or a comparable therapeutic effect as the corresponding glucose regulating peptide that lacks the XTEN; or (iii) an accumulative smaller molar amount (e.g. about 5%, or about 10%, or about 20%, or about 40%, or about 50%, or about 60%, or about 70%, or about 80%, or about 90% less) of the fusion protein is administered in comparison to the corresponding glucose regulating peptide that lacks the XTEN under the otherwise same dose regimen the fusion protein achieves a comparable area under the curve and/or a comparable therapeutic effect as the corresponding glucose regulating peptide that lacks the XTEN. The accumulative smaller molar amount is measure for a period of at least about one week, or about 14 days, or about 21 days, or about one month. In some embodiments of the method, the therapeutic effect is a measured parameter selected from HbA1c concentrations, insulin concentrations, stimulated C peptide, fasting plasma glucose (FPG), serum cytokine levels, CRP levels, insulin secretion and Insulin-sensitivity index derived from an oral glucose tolerance test (OGTT), body weight, and food consumption.

In another embodiment, invention provides a method of treating a disease, disorder or condition, comprising administering the pharmaceutical composition described above to a subject using multiple consecutive doses of the pharmaceutical composition administered using a therapeutically effective dose regimen. In one embodiment of the foregoing, the therapeutically effective dose regimen can result in a gain in time of at least three-fold, or alternatively, at least four-fold, or five-fold, or six-fold, or seven-fold, or eight-fold, or nine-fold, or at least 10-fold, or at least 20-fold, or at least about 30-fold, or at least about 50-fold, or at least about 100-fold longer time between at least two consecutive $C_{max}$ peaks and/or $C_{min}$ troughs for blood levels of the fusion protein compared to the corresponding GP of the fusion protein not linked to the fusion protein and administered at a comparable dose regimen to a subject. In another embodiment of the foregoing, the administration of the fusion protein results in improvement in at least one measured parameter of a glucose regulating peptide-related disease using less frequent dosing or a lower total dosage in moles of the fusion protein of the pharmaceutical composition compared to the corresponding biologically active protein component(s) not linked to the fusion protein and administered to a subject d using a therapeutically effective regimen to a subject.

The invention further provides use of the compositions comprising the fusion protein of any of the foregoing embodiments in the preparation of a medicament for treating a disease, disorder or condition in a subject in need thereof. In one embodiment of the foregoing, the disease, disorder or condition is selected from, but not limited to, juvenile diabetes, type I diabetes, type II diabetes, obesity, acute hypoglycemia, acute hyperglycemia, nocturnal hypoglycemia, chronic hyperglycemia, glucagonomas, secretory disorders of the airway, arthritis, osteoporosis, central nervous system disease, restenosis, neurodegenerative disease, renal failure, congestive heart failure, nephrotic syndrome, cirrhosis, pulmonary edema, hypertension, and disorders wherein the reduction of food intake is desired, stroke, irritable bowel syndrome, myocardial infarction (e.g., reducing the morbidity and/or mortality associated therewith), stroke, acute coronary syndrome (e.g., characterized by an absence of Q-wave) myocardial infarction, post-surgical catabolic changes, hibernating myocardium or diabetic cardiomyopathy, insufficient urinary sodium excretion, excessive urinary potassium concentration, conditions or disorders associated with toxic hypervolemia, (e.g., renal failure, congestive heart failure, nephrotic syndrome, cirrhosis, pulmonary edema, and hypertension), polycystic ovary syndrome, respiratory distress, nephropathy, left ventricular systolic dysfunction, (e.g., with abnormal left ventricular ejection fraction), gastrointestinal disorders such as diarrhea, postoperative dumping syndrome and irritable bowel syndrome, (i.e., via inhibition of antro-duodenal motility), critical illness polyneuropathy (CIPN), dyslipidemia, organ tissue injury caused by reperfusion of blood flow following ischemia, and coronary heart disease risk factor (CHDRF) syndrome, and any other indication for which the unmodified glucose-regulating peptide (e.g. exendin-4, GLP-1 or glucagon) is utilized, or any other indication for which GP can be utilized (but for which endogenous glucose regulating peptide levels in a subject are not necessarily deficient). Any of the disclosed embodiments can be practiced alone or in combination depending on the interested application.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 1A shows two different configurations of GPXTEN fusion proteins (100), each comprising a single GP and an XTEN, the first of which has an XTEN molecule (102) attached to the C-terminus of a GP (103), and the second of which has an XTEN molecule attached to the N-terminus of a GP (103). FIG. 1B shows two different configurations of GPXTEN fusion proteins (100), each comprising a single GP, a spacer sequence and an XTEN, the first of which has an XTEN molecule (102) attached to the C-terminus of a spacer sequence (104) and the spacer sequence attached to the C-terminus of a GP (103) and the second of which has an XTEN molecule attached to the N-terminus of a spacer sequence (104) and the spacer sequence attached to the N-terminus of a GP (103). FIG. 1C shows two different configurations of GPXTEN fusion proteins (101), each comprising two molecules of a single GP and one molecule of an XTEN, the first of which has an XTEN linked to the C-terminus of a first GP and that GP is linked to the C-terminus of a second GP, and the second of which is in the opposite orientation in which the XTEN is linked to the N-terminus of a first GP and that GP is linked to the N-terminus of a second GP. FIG. 1D shows two different configurations of GPXTEN fusion proteins (101), each comprising two molecules of a single GP, a spacer sequence and one molecule of an XTEN, the first of which has an XTEN linked to the C-terminus of a spacer sequence and the spacer sequence linked to the C-terminus of a first GP which is linked to the C-terminus of a second GP, and the second of which is in the opposite orientation in which the XTEN is linked to the N-terminus of a spacer sequence and the spacer sequence is linked to the N-terminus of a first GP that that GP is linked to the N-terminus of a second GP. FIG. 1E shows two different configurations of GPXTEN fusion proteins (101), each comprising two molecules of a single GP, a spacer sequence and one molecule of an XTEN, the first of which has an XTEN linked to the C-terminus of a first GP and the first GP linked to the C-terminus of a spacer sequence which is linked to the C-terminus of a second GP molecule, and the second of which is in the opposite configuration of XTEN linked to the N-terminus of a first GP which is linked to the N-terminus of a spacer sequence which in turn is linked to the N-terminus of a second molecule of GP. FIG. 1F shows a configuration of GPXTEN fusion protein (105), each comprising one molecule of GP and two molecules of an XTEN linked to the N-terminus and the C-terminus of the GP. FIG. 1G shows a configuration (106) of a single GP linked to two XTEN, with the second XTEN separated from the GP by a spacer sequence. FIG. 1H is a configuration (106) of a two GP linked to two XTEN, with the second XTEN linked to the C-terminus of the first GP and the N-terminus of the second GP, which is at the C-terminus of the GPXTEN.

FIG. 3A shows a GPXTEN fusion protein (100) consisting of a GP (103) and an XTEN (102) and a second GPXTEN fusion protein (105) consisting of a GP linked to two XTEN (105). FIG. 3B shows the interaction of the GPXTEN with the GP on the C-terminus (100) and the GPXTEN with an XTEN on the C-terminus (105) with target receptors (108) to GP on a cell surface (107). In this case, binding to the receptor with high affinity is exhibited when GP has a free C-terminus, while the GPXTEN with a C-terminal XTEN does not bind tightly to the receptor, and disassociates, as seen in FIG. 3C. FIG. 3D shows that the bound GPXTEN (100) with high binding affinity remains bound to the receptor (106) and has been internalized into an endosome (110) within the cell, illustrating receptor-mediated clearance of the bound GP and triggering cell signaling (109), portrayed as stippled cytoplasm.

FIG. 7A shows an exemplary expression vector encoding XTEN fused to the 3' end of the sequence encoding biologically active protein Ex4. Note that no additional leader sequences are required in this vector. FIG. 7B depicts an expression vector encoding XTEN fused to the 5' end of the sequence encoding Ex4 with a CBD leader sequence and a TEV protease site. FIG. 7C depicts an expression vector as in FIG. 7B where the CBD and TEV processing site have been replaced with an optimized N-terminal leader sequence (NTS). FIG. 7D depicts an expression vector encoding an NTS sequence, an XTEN, a sequence encoding Ex4, and than a second sequence encoding an XTEN.

FIG. 10 shows three randomized libraries used for the third and fourth codons in the N-terminal sequences of clones from LCW546, LCW547 and LCW552, as described in Example 15. The libraries were designed with the third and fourth residues modified such that all combinations of allowable XTEN codons were present at these positions, as shown. In order to include all the allowable XTEN codons for each library, nine pairs of oligonucleotides encoding 12 amino acids with codon diversities of third and fourth residues were designed, annealed and ligated into the NdeI/BsaI restriction enzyme digested stuffer vector pCW0551 (Stuffer-XTE-N_AM875-GFP), and transformed into E. coli BL21Gold (DE3) competent cells to obtin colonies of the three libraries LCW0569 (DNA and protein sequences disclosed as SEQ ID NOS 1338 and 1339, respectively), LCW0570 (DNA and protein sequences disclosed as SEQ ID NOS 1340 and 1341, respectively), and LCW0571 (DNA and protein sequences disclosed as SEQ ID NOS 1342 and 1343, respectively).

FIG. 18A shows measured terminal half-life versus body mass, with a predicted T½ in humans of 139 h. FIG. 18B shows measured drug clearance versus body mass, with a predicted clearance rate value of 30 ml/h in humans. FIG. 18C shows measured volume of distribution versus body mass, with a predicted value of 5970 ml in humans.

FIG. 19A is a SDS-PAGE analysis of the purified protein product (lane 2). Molecular weight markers are shown in lane 1 with relevant size markers labeled at the left. Note that the true molecular weight of the molecule is 16305 Daltons (confirmed by mass spectrometry; not shown). Slow migration in SDS-PAGE relative to globular protein standards is typical of XTEN fusion proteins due to differences in primary amino acid composition. FIG. 19B shows results of a glucagon receptor (GcgR) Ca2+-flux assay comparing the efficacy of Gcg-XTEN to unmodified glucagon. Calculated EC50 values for each curve fit are shown. FIG. 19C shows results of a reverse phase C18 HPLC analysis. FIG. 19D shows results of a size exclusion chromatography HPLC analysis of the purified Gcg-XTEN construct at the time of production. FIG. 19E shows results of a reverse phase C18 HPLC analysis. FIG. 19F shows results of size exclusion chromatography HPLC analyses of Gcg-XTEN after 6 months storage at either –80° C., 2-8° C., or 25° C., with all three curves essentially superimposed.

FIG. 21C represents a hypothetical timeline for human administration over a meal-sleep-wake cycle that is intended to correspond to the dosage administration and experimental design of the experiment.

FIGS. 22A-C show overlaid plots of blood glucose profiles after placebo or Gcg-XTEN288 administration for three individual cynomolgus monkeys. Solid arrows mark the time when food was returned to the animals (t=6 hours).

DETAILED DESCRIPTION OF THE INVENTION

Figure 1:
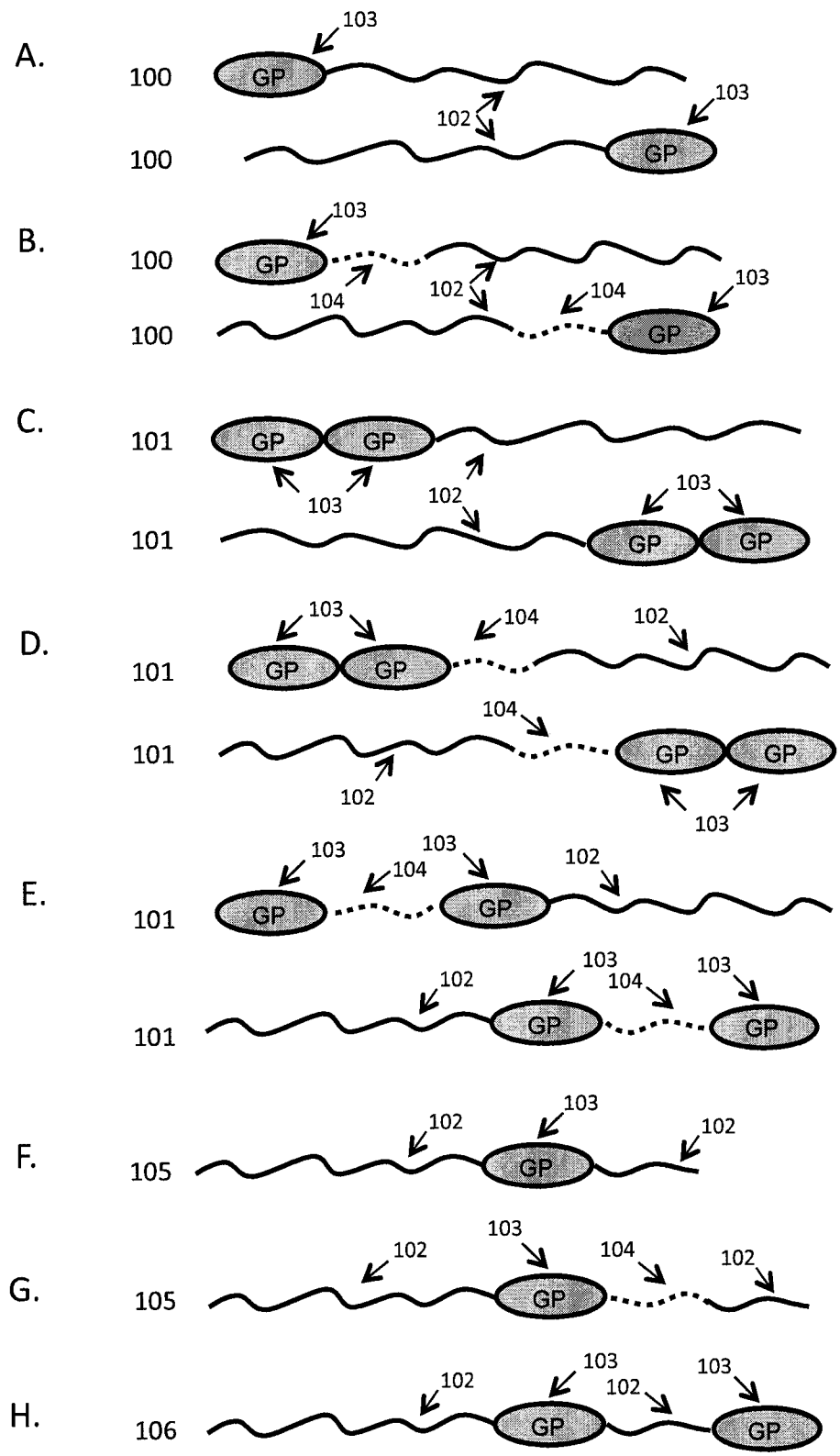
FIG. 1 shows schematic representations of exemplary GPXTEN fusion proteins (FIGS. 1A-H), all depicted in an N- to C-terminus orientation.

Before the embodiments of the invention are described, it is to be understood that such embodiments are provided by way of example only, and that various alternatives to the embodiments of the invention described herein may be employed in practicing the invention. Numerous variations, changes, and substitutions will now occur to those skilled in the art without departing from the invention.

Unless otherwise defined, all technical and scientific terms used herein have the same meaning as commonly understood by one of ordinary skill in the art to which this invention belongs. Although methods and materials similar or equivalent to those described herein, can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

DEFINITIONS

As used herein, the following terms have the meanings ascribed to them unless specified otherwise.

As used in the specification and claims, the singular forms "a", "an" and "the" include plural references unless the context clearly dictates otherwise. For example, the term "a cell" includes a plurality of cells, including mixtures thereof.

The terms "polypeptide", "peptide", and "protein" are used interchangeably herein to refer to polymers of amino acids of any length. The polymer may be linear or branched, it may comprise modified amino acids, and it may be interrupted by non amino acids. The terms also encompass an amino acid polymer that has been modified, for example, by disulfide bond formation, glycosylation, lipidation, acetylation, phosphorylation, or any other manipulation, such as conjugation with a labeling component.

As used herein the term "amino acid" refers to either natural and/or unnatural or synthetic amino acids, including but not limited to glycine and both the D or L optical isomers, and amino acid analogs and peptidomimetics. Standard single or three letter codes are used to designate amino acids.

The term "natural L-amino acid" means the L optical isomer forms of glycine (G), proline (P), alanine (A), valine (V), leucine (L), isoleucine (I), methionine (M), cysteine (C), phenylalanine (F), tyrosine (Y), tryptophan (W), histidine (H), lysine (K), arginine (R), glutamine (Q), asparagine (N), glutamic acid (E), aspartic acid (D), serine (S), and threonine (T).

The term "non-naturally occurring," as applied to sequences and as used herein, means polypeptide or polynucleotide sequences that do not have a counterpart to, are not complementary to, or do not have a high degree of homology with a wild-type or naturally-occurring sequence found in a mammal. For example, a non-naturally occurring polypeptide may share no more than 99%, 98%, 95%, 90%, 80%, 70%, 60%, 50% or even less amino acid sequence identity as compared to a natural sequence when suitably aligned.

The terms "hydrophilic" and "hydrophobic" refer to the degree of affinity that a substance has with water. A hydrophilic substance has a strong affinity for water, tending to dissolve in, mix with, or be wetted by water, while a hydrophobic substance substantially lacks affinity for water, tending to repel and not absorb water and tending not to dissolve in or mix with or be wetted by water. Amino acids can be characterized based on their hydrophobicity. A number of scales have been developed. An example is a scale developed by Levitt, M, et al., J Mol Biol (1976) 104:59, which is listed in Hopp, T P, et al., Proc Natl Acad Sci USA (1981) 78:3824. Examples of "hydrophilic amino acids" are arginine, lysine, threonine, alanine, asparagine, and glutamine. Of particular interest are the hydrophilic amino acids aspartate, glutamate, and serine, and glycine. Examples of "hydrophobic amino acids" are tryptophan, tyrosine, phenylalanine, methionine, leucine, isoleucine, and valine.

A "fragment" is a truncated form of a native biologically active protein that retains at least a portion of the therapeutic and/or biological activity. A "variant" is a protein with sequence homology to the native biologically active protein that retains at least a portion of the therapeutic and/or biological activity of the biologically active protein. For example, a variant protein may share at least 70%, 75%, 80%, 85%, 90%, 95%, 96%, 97%, 98% or 99% amino acid sequence identity with the reference biologically active protein. As used herein, the term "biologically active protein moiety" includes proteins modified deliberately, as for example, by site directed mutagenesis, insertions, or accidentally through mutations.

A "host cell" includes an individual cell or cell culture which can be or has been a recipient for the subject vectors. Host cells include progeny of a single host cell. The progeny may not necessarily be completely identical (in morphology or in genomic of total DNA complement) to the original parent cell due to natural, accidental, or deliberate mutation. A host cell includes cells transfected in vivo with a vector of this invention.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. As is apparent to those of skill in the art, a non-naturally occurring polynucleotide, peptide, polypeptide, protein, antibody, or fragments thereof, does not require "isolation" to distinguish it from its naturally occurring counterpart. In addition, a "concentrated", "separated" or "diluted" polynucleotide, peptide, polypeptide, protein, antibody, or fragments thereof, is distinguishable from its naturally occurring counterpart in that the concentration or number of molecules per volume is generally greater than that of its naturally occurring counterpart. In general, a polypeptide made by recombinant means and expressed in a host cell is considered to be "isolated."

An "isolated" polynucleotide or polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal or extra-chromosomal location different from that of natural cells.

A "chimeric" protein contains at least one fusion polypeptide comprising regions in a different position in the sequence than that which occurs in nature. The regions may normally exist in separate proteins and are brought together in the fusion polypeptide; or they may normally exist in the same protein but are placed in a new arrangement in the fusion polypeptide. A chimeric protein may be created, for example, by chemical synthesis, or by creating and translating a polynucleotide in which the peptide regions are encoded in the desired relationship.

"Conjugated", "linked," "fused," and "fusion" are used interchangeably herein. These terms refer to the joining together of two or more chemical elements or components, by whatever means including chemical conjugation or recombinant means. For example, a promoter or enhancer is operably linked to a coding sequence if it affects the transcription of the sequence. Generally, "operably linked" means that the DNA sequences being linked are contiguous, and in reading phase or in-frame. An "in-frame fusion" refers to the joining of two or more open reading frames (ORFs) to form a continuous longer ORF, in a manner that maintains the correct reading frame of the original ORFs. Thus, the resulting recombinant fusion protein is a single protein containing two or more segments that correspond to polypeptides encoded by the original ORFs (which segments are not normally so joined in nature).

In the context of polypeptides, a "linear sequence" or a "sequence" is an order of amino acids in a polypeptide in an amino to carboxyl terminus direction in which residues that neighbor each other in the sequence are contiguous in the primary structure of the polypeptide. A "partial sequence" is a linear sequence of part of a polypeptide that is known to comprise additional residues in one or both directions.

"Heterologous" means derived from a genotypically distinct entity from the rest of the entity to which it is being compared. For example, a glycine rich sequence removed from its native coding sequence and operatively linked to a coding sequence other than the native sequence is a heterologous glycine rich sequence. The term "heterologous" as applied to a polynucleotide, a polypeptide, means that the polynucleotide or polypeptide is derived from a genotypically distinct entity from that of the rest of the entity to which it is being compared.

The terms "polynucleotides", "nucleic acids", "nucleotides" and "oligonucleotides" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

The term "complement of a polynucleotide" denotes a polynucleotide molecule having a complementary base sequence and reverse orientation as compared to a reference sequence, such that it could hybridize with a reference sequence with complete fidelity.

"Recombinant" as applied to a polynucleotide means that the polynucleotide is the product of various combinations of in vitro cloning, restriction and/or ligation steps, and other procedures that result in a construct that can potentially be expressed in a host cell.

The terms "gene" or "gene fragment" are used interchangeably herein. They refer to a polynucleotide containing at least one open reading frame that is capable of encoding a particular protein after being transcribed and translated. A gene or gene fragment may be genomic or cDNA, as long as the polynucleotide contains at least one open reading frame, which may cover the entire coding region or a segment thereof. A "fusion gene" is a gene composed of at least two heterologous polynucleotides that are linked together.

"Homology" or "homologous" refers to sequence similarity or interchangeability between two or more polynucleotide sequences or two or more polypeptide sequences. When using a program such as BestFit to determine sequence identity, similarity or homology between two different amino acid sequences, the default settings may be used, or an appropriate scoring matrix, such as blosum45 or blosum80, may be selected to optimize identity, similarity or homology scores. Preferably, polynucleotides that are homologous are those which hybridize under stringent conditions as defined herein and have at least 70%, or at least 80%, or at least 90%, or 95%, or 97%, or 98%, or 99% sequence identity to those sequences.

"Ligation" refers to the process of forming phosphodiester bonds between two nucleic acid fragments or genes, linking them together. To ligate the DNA fragments or genes together, the ends of the DNA must be compatible with each other. In some cases, the ends will be directly compatible after endonuclease digestion. However, it may be necessary to first convert the staggered ends commonly produced after endonuclease digestion to blunt ends to make them compatible for ligation.

The terms "stringent conditions" or "stringent hybridization conditions" includes reference to conditions under which a polynucleotide will hybridize to its target sequence, to a detectably greater degree than other sequences (e.g., at least 2-fold over background). Generally, stringency of hybridization is expressed, in part, with reference to the temperature and salt concentration under which the wash step is carried out. Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short polynucleotides (e.g., 10 to 50 nucleotides) and at least about 60° C. for long polynucleotides (e.g., greater than 50 nucleotides)—for example, "stringent conditions" can include hybridization in 50% formamide, 1 M NaCl, 1% SDS at 37° C., and three washes for 15 min each in 0.1×SSC/1% SDS at 60 to 65° C. Alternatively, temperatures of about 65° C., 60° C., 55° C., or 42° C. may be used. SSC concentration may be varied from about 0.1 to 2×SSC, with SDS being present at about 0.1%. Such wash temperatures are typically selected to be about 5° C. to 20° C. lower than the thermal melting point for the specific sequence at a defined ionic strength and pH. The Tm is the temperature (under defined ionic strength and pH) at which 50% of the target sequence hybridizes to a perfectly matched probe. An equation for calculating Tm and conditions for nucleic acid hybridization are well known and can be found in Sambrook, J. et al. (1989) Molecular Cloning: A Laboratory Manual, $2^{nd}$ ed., vol. 1-3, Cold Spring Harbor Press, Plainview N.Y.; specifically see volume 2 and chapter 9. Typically, blocking reagents are used to block non-specific hybridization. Such blocking reagents include, for instance, sheared and denatured salmon sperm DNA at about 100-200 μg/ml. Organic solvent, such as formamide at a concentration of about 35-50% v/v, may also be used under particular circumstances, such as for RNA:DNA hybridizations. Useful variations on these wash conditions will be readily apparent to those of ordinary skill in the art.

The terms "percent identity" and "% identity," as applied to polynucleotide sequences, refer to the percentage of residue matches between at least two polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. Percent identity may be measured over the length of an entire defined polynucleotide sequence, for example, as defined by a particular SEQ ID number, or may be measured over a shorter length; for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, may be used to describe a length over which percentage identity may be measured.

"Percent (%) amino acid sequence identity," with respect to the polypeptide sequences identified herein, is defined as the percentage of amino acid residues in a query sequence that are identical with the amino acid residues of a second, reference polypeptide sequence or a portion thereof, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. Percent identity may be measured over the length of an entire defined polypeptide sequence, for example, as defined by a particular SEQ ID number, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

The term "non-repetitiveness" as used herein in the context of a polypeptide refers to a lack or limited degree of internal homology in a peptide or polypeptide sequence. The term "substantially non-repetitive" can mean, for example, that there are few or no instances of four contiguous amino acids in the sequence that are identical amino acid types or that the polypeptide has a subsequence score (defined infra) of 10 or less or that there isn't a pattern in the order, from N- to C-terminus, of the sequence motifs that constitute the polypeptide sequence. The term "repetitiveness" as used herein in the context of a polypeptide refers to the degree of internal homology in a peptide or polypeptide sequence. In contrast, a "repetitive" sequence may contain multiple identical copies of short amino acid sequences. For instance, a polypeptide sequence of interest may be divided into n-mer sequences and the number of identical sequences can be counted. Highly repetitive sequences contain a large fraction of identical sequences while non-repetitive sequences contain few identical sequences. In the context of a polypeptide, a sequence can contain multiple copies of shorter sequences of defined or variable length, or motifs, in which the motifs themselves have non-repetitive sequences, rendering the full-length polypeptide substantially non-repetitive. The length of polypeptide within which the non-repetitiveness is measured can vary from 3 amino acids to about 200 amino acids, about from 6 to about 50 amino acids, or from about 9 to about 14 amino acids. "Repetitiveness" used in the context of polynucleotide sequences refers to the degree of internal homology in the sequence such as, for example, the frequency of identical nucleotide sequences of a given length. Repetitiveness can, for example, be measured by analyzing the frequency of identical sequences.

A "vector" is a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide(s). An "expression system" usually connotes a suitable host cell comprised of an expression vector that can function to yield a desired expression product.

"Serum degradation resistance," as applied to a polypeptide, refers to the ability of the polypeptides to withstand degradation in blood or components thereof, which typically involves proteases in the serum or plasma. The serum degradation resistance can be measured by combining the protein with human (or mouse, rat, monkey, as appropriate) serum or plasma, typically for a range of days (e.g. 0.25, 0.5, 1, 2, 4, 8, 16 days), typically at about 37° C. The samples for these time points can be run on a Western blot assay and the protein is detected with an antibody. The antibody can be to a tag in the protein. If the protein shows a single band on the western, where the protein's size is identical to that of the injected protein, then no degradation has occurred. In this exemplary method, the time point where 50% of the protein is degraded, as judged by Western blots or equivalent techniques, is the serum degradation half-life or "serum half-life" of the protein.

The term "$t_{1/2}$" as used herein means the terminal half-life calculated as $\ln(2)/K_{el}$. $K_{el}$ is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes. The terms "$t_{1/2}$", "terminal half-life", "elimination half-life" and "circulating half-life" are used interchangeably herein.

"Apparent Molecular Weight Factor" or "Apparent Molecular Weight" are related terms referring to a measure of the relative increase or decrease in apparent molecular weight exhibited by a particular amino acid sequence. The Apparent Molecular Weight is determined using size exclusion chromatography (SEC) and similar methods compared to globular protein standards and is measured in "apparent kD" units. The Apparent Molecular Weight Factor is the ratio between the Apparent Molecular Weight and the actual molecular weight; the latter predicted by adding, based on amino acid composition, the calculated molecular weight of each type of amino acid in the composition.

The "hydrodynamic radius" or "Stokes radius" is the effective radius ($R_h$ in nm) of a molecule in a solution measured by assuming that it is a body moving through the solution and resisted by the solution's viscosity. In the embodiments of the invention, the hydrodynamic radius measurements of the XTEN fusion proteins correlate with the 'Apparent Molecular Weight Factor', which is a more intuitive measure. The "hydrodynamic radius" of a protein affects its rate of diffusion in aqueous solution as well as its ability to migrate in gels of macromolecules. The hydrodynamic radius of a protein is determined by its molecular weight as well as by its structure, including shape and compactness. Methods for determining the hydrodynamic radius are well known in the art, such as by the use of size exclusion chromatography (SEC), as described in U.S. Pat. Nos. 6,406,632 and 7,294,513. Most proteins have globular structure, which is the most compact three-dimensional structure a protein can have with the smallest hydrodynamic radius. Some proteins adopt a random and open, unstructured, or 'linear' conformation and as a result have a much larger hydrodynamic radius compared to typical globular proteins of similar molecular weight.

"Physiological conditions" refer to a set of conditions in a living host as well as in vitro conditions, including temperature, salt concentration, pH, that mimic those conditions of a living subject. A host of physiologically relevant conditions for use in in vitro assays have been established. Generally, a physiological buffer contains a physiological concentration of salt and is adjusted to a neutral pH ranging from about 6.5 to about 7.8, and preferably from about 7.0 to about 7.5. A variety of physiological buffers is listed in Sambrook et al. (1989). Physiologically relevant temperature ranges from about 25° C. to about 38° C., and preferably from about 35° C. to about 37° C.

A "reactive group" is a chemical structure that can be coupled to a second reactive group. Examples for reactive groups are amino groups, carboxyl groups, sulfhydryl groups, hydroxyl groups, aldehyde groups, azide groups. Some reactive groups can be activated to facilitate coupling with a second reactive group. Examples for activation are the reaction of a carboxyl group with carbodiimide, the conversion of a carboxyl group into an activated ester, or the conversion of a carboxyl group into an azide function.

"Controlled release agent", "slow release agent", "depot formulation" or "sustained release agent" are used interchangeably to refer to an agent capable of extending the duration of release of a polypeptide of the invention relative to the duration of release when the polypeptide is administered in the absence of agent. Different embodiments of the present invention may have different release rates, resulting in different therapeutic amounts.

The terms "antigen", "target antigen" or "immunogen" are used interchangeably herein to refer to the structure or binding determinant that an antibody fragment or an antibody fragment-based therapeutic binds to or has specificity against.

The term "payload" as used herein refers to a protein or peptide sequence that has biological or therapeutic activity; the counterpart to the pharmacophore of small molecules. Examples of payloads include, but are not limited to, cytokines, enzymes, hormones and blood and growth factors. Payloads can further comprise genetically fused or chemically conjugated moieties such as chemotherapeutic agents, antiviral compounds, toxins, or contrast agents. These conjugated moieties can be joined to the rest of the polypeptide via a linker that may be cleavable or non-cleavable.

The term "antagonist", as used herein, includes any molecule that partially or fully blocks, inhibits, or neutralizes a biological activity of a native polypeptide disclosed herein. Methods for identifying antagonists of a polypeptide may comprise contacting a native polypeptide with a candidate antagonist molecule and measuring a detectable change in one or more biological activities normally associated with the native polypeptide. In the context of the present invention, antagonists may include proteins, nucleic acids, carbohydrates, antibodies or any other molecules that decrease the effect of a biologically active protein.

The term "agonist" is used in the broadest sense and includes any molecule that mimics a biological activity of a native polypeptide disclosed herein. Suitable agonist molecules specifically include agonist antibodies or antibody fragments, fragments or amino acid sequence variants of native polypeptides, peptides, small organic molecules, etc. Methods for identifying agonists of a native polypeptide may comprise contacting a native polypeptide with a candidate agonist molecule and measuring a detectable change in one or more biological activities normally associated with the native polypeptide.

"Activity" for the purposes herein refers to an action or effect of a component of a fusion protein consistent with that of the corresponding native biologically active protein, wherein "biological activity" refers to an in vitro or in vivo biological function or effect, including but not limited to receptor binding, antagonist activity, agonist activity, or a cellular or physiologic response.

As used herein, "treatment" or "treating," or "palliating" or "ameliorating" is used interchangeably herein. These terms refer to an approach for obtaining beneficial or desired results including but not limited to a therapeutic benefit and/or a prophylactic benefit. By therapeutic benefit is meant eradication or amelioration of the underlying disorder being treated. Also, a therapeutic benefit is achieved with the eradication or amelioration of one or more of the physiological symptoms associated with the underlying disorder such that an improvement is observed in the subject, notwithstanding that the subject may still be afflicted with the underlying disorder. For prophylactic benefit, the compositions may be administered to a subject at risk of developing a particular disease, or to a subject reporting one or more of the physiological symptoms of a disease, even though a diagnosis of this disease may not have been made.

A "therapeutic effect", as used herein, refers to a physiologic effect, including but not limited to the cure, mitigation, amelioration, or prevention of disease in humans or other animals, or to otherwise enhance physical or mental wellbeing of humans or animals, caused by a fusion polypeptide of the invention other than the ability to induce the production of an antibody against an antigenic epitope possessed by the biologically active protein. Determination of a therapeutically effective amount is well within the capability of those skilled in the art, especially in light of the detailed disclosure provided herein.

The terms "therapeutically effective amount" and "therapeutically effective dose", as used herein, refers to an amount of a biologically active protein, either alone or as a part of a fusion protein composition, that is capable of having any detectable, beneficial effect on any symptom, aspect, measured parameter or characteristics of a disease state or condition when administered in one or repeated doses to a subject. Such effect need not be absolute to be beneficial.

The term "therapeutically effective dose regimen", as used herein, refers to a schedule for consecutively administered doses of a biologically active protein, either alone or as a part of a fusion protein composition, wherein the doses are given in therapeutically effective amounts to result in sustained beneficial effect on any symptom, aspect, measured parameter or characteristics of a disease state or condition.

I) General Techniques

The practice of the present invention employs, unless otherwise indicated, conventional techniques of immunology, biochemistry, chemistry, molecular biology, microbiology, cell biology, genomics and recombinant DNA, which are within the skill of the art. See Sambrook, J. et al., "Molecular Cloning: A Laboratory Manual," $3^{rd}$ edition, Cold Spring Harbor Laboratory Press, 2001; "Current protocols in molecular biology", F. M. Ausubel, et al. eds., 1987; the series "Methods in Enzymology," Academic Press, San Diego, Calif.; "PCR 2: a practical approach", M. J. MacPherson, B. D. Hames and G. R. Taylor eds., Oxford University Press, 1995; "Antibodies, a laboratory manual" Harlow, E. and Lane, D. eds., Cold Spring Harbor Laboratory, 1988; "Goodman & Gilman's The Pharmacological Basis of Therapeutics," $11^{th}$ Edition, McGraw-Hill, 2005; and Freshney, R. I., "Culture of Animal Cells: A Manual of Basic Technique," $4^{th}$ edition, John Wiley & Sons, Somerset, N.J., 2000, the contents of which are incorporated in their entirety herein by reference.

II) Glucose Regulating Peptides

The present invention relates in part to fusion protein compositions comprising glucose regulating peptides (GP). Such compositions can have utility in the treatment or prevention of certain diseases, disorder or conditions related to glucose homeostasis, obesity, insulin resistance, dyslipidemia, hypertension, and the like.

Endocrine and obesity-related diseases or disorders have reached epidemic proportions in most developed nations, and represent a substantial and increasing health care burden in most developed nations, which include a large variety of conditions affecting the organs, tissues, and circulatory system of the body. Of particular concern are endocrine and obesity-related diseases and disorders, which. Chief amongst these is diabetes; one of the leading causes of death in the United States. Diabetes is divided into two major sub-classes-Type I, also known as juvenile diabetes, or Insulin-Dependent Diabetes Mellitus (IDDM), and Type II, also known as adult onset diabetes, or Non-Insulin-Dependent Diabetes Mellitus (NIDDM). Type I Diabetes is a form of autoimmune disease that completely or partially destroys the insulin producing cells of the pancreas in such subjects, and requires use of exogenous insulin during their lifetime. Even in well-managed subjects, episodic complications can occur, some of which are life-threatening.

In Type II diabetics, rising blood glucose levels after meals do not properly stimulate insulin production by the pancreas. Additionally, peripheral tissues are generally resistant to the effects of insulin, and such subjects often have higher than normal plasma insulin levels (hyperinsulinemia) as the body attempts to overcome its insulin resistance. In advanced disease states insulin secretion is also impaired.

Insulin resistance and hyperinsulinemia have also been linked with two other metabolic disorders that pose considerable health risks: impaired glucose tolerance and metabolic obesity. Impaired glucose tolerance is characterized by normal glucose levels before eating, with a tendency toward elevated levels (hyperglycemia) following a meal. These individuals are considered to be at higher risk for diabetes and coronary artery disease. Obesity is also a risk factor for the group of conditions called insulin resistance syndrome, or "Syndrome X," as is hypertension, coronary artery disease (arteriosclerosis), and lactic acidosis, as well as related disease states. The pathogenesis of obesity is believed to be multifactorial but an underlying problem is that in the obese, nutrient availability and energy expenditure are not in balance until there is excess adipose tissue. Other related diseases or disorders include, but are not limited to, gestational diabetes, juvenile diabetes, obesity, excessive appetite, insufficient satiety, metabolic disorder, glucagonomas, retinal neurodegenerative processes, and the "honeymoon period" of Type I diabetes.

Dyslipidemia is a frequent occurrence among diabetics; typically characterized by elevated plasma triglycerides, low HDL (high density lipoprotein) cholesterol, normal to elevated levels of LDL (low density lipoprotein) cholesterol and increased levels of small dense, LDL particles in the blood. Dyslipidemia is a main contributor to an increased incidence of coronary events and deaths among diabetic subjects.

Most metabolic processes in glucose homeostasis and insulin response are regulated by multiple peptides and hormones, and many such peptides and hormones, as well as analogues thereof, have found utility in the treatment of metabolic diseases and disorders. Many of these peptides tend to be highly homologous to each other, even when they possess opposite biological functions. Glucose-increasing peptides are exemplified by the peptide hormone glucagon, while glucose-lowering peptides include exendin-4, glucagon-like peptide 1, and amylin. However, the use of therapeutic peptides and/or hormones, even when augmented by the use of small molecule drugs, has met with limited success in the management of such diseases, disorders and conditions. In particular, dose optimization is important for drugs and biologics used in the treatment of metabolic diseases, especially those with a narrow therapeutic window. Hormones in general, and peptides involved in glucose homeostasis often have a narrow therapeutic window. The narrow therapeutic window, coupled with the fact that such hormones and peptides typically have a short half-life, which necessitates frequent dosing in order to achieve clinical benefit, results in difficulties in the management of such patients. While chemical modifications to a therapeutic protein, such as pegylation, can modify its in vivo clearance rate and subsequent serum half-life, it requires additional manufacturing steps and results in a heterogeneous final product. In addition, unacceptable side effects from chronic administration have been reported. Alternatively, genetic modification by fusion of an Fc domain to the therapeutic protein or peptide increases the size of the therapeutic protein, reducing the rate of clearance through the kidney, and promotes recycling from lysosomes by the FcRn receptor. Unfortunately, the Fc domain does not fold efficiently during recombinant expression and tends to form insoluble precipitates known as inclusion bodies. These inclusion bodies must be solubilized and functional protein must be renatured; a time-consuming, inefficient, and expensive process.

Thus, one aspect of the present invention is the incorporation of peptides involved in glucose homeostasis, insulin resistance and obesity (collectively, "glucose regulating peptides") in GPXTEN fusion proteins to create compositions that can be used in the treatment of glucose, insulin, and obesity disorders, diseases and related conditions (referred to herein as "glucose regulating peptide-related diseases, disorders or conditions"). Glucose regulating peptides can include any protein of biologic, therapeutic, or prophylactic interest or function that is useful for preventing, treating, mediating, or ameliorating a disease, disorder or condition of glucose homeostasis or insulin resistance or obesity. Suitable glucose-regulating peptides that can be linked to the XTEN to create GPXTEN include all biologically active polypeptides that increase glucose-dependent secretion of insulin by pancreatic beta-cells or potentiate the action of insulin or play a role in glucose homeostasis. Glucose-regulating peptides can also include all biologically active polypeptides that stimulate pro-insulin gene transcription in the pancreatic beta-cells. Furthermore, glucose-regulating peptides can also include all biologically active polypeptides that slow down gastric emptying time and reduce food intake. Glucose-regulating peptides can also include all biologically active polypeptides that inhibit glucagon release from the alpha cells of the Islets of Langerhans. Table 1 provides a non-limiting list of sequences of glucose regulating peptides that are encompassed by the GPXTEN fusion proteins of the invention. Glucose regulating peptides of the inventive GPXTEN compositions can be a peptide that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Table 1.

TABLE 1

Glucose regulating peptides from animal species

| Name of Protein (Synonym) | Sequence | SEQ ID NO: |
|---|---|---|
| Amylin, rat | KCNTATCATQRLANFLVRSSNNLGPVLP PTNVGSNTY | 1 |
| Amylin, human | KCNTATCATQRLANFLVHSSNNFGAILS STNVGSNTY | 2 |
| Exendin-3 | HSDGTFTSDLSKQMEEEAVRLFIEWLKN GGPSSGAPPPS | 3 |
| Exendin-4 | HGEGTFTSDLSKQMEEEAVRLFIEWLKN GGPSSGAPPPS | 4 |
| Glucagon | HSQGTFTSDYSKYLDSRRAQDFVQWLMN T | 5 |
| Glucagon-like peptide-1 (hGLP-1) (GLP-1; 1-37) | HDEFERHAEGTFTSDVSSTLEGQAALEF IAWLVKGRG | 6 |
| GLP-1 (7-36), human | HAEGTFTSDVSSYLEGQAALEFIAWLV KGR | 7 |
| GLP-1 (7-37), human | HAEGTFTSDVSSTLEGQAALEFIAWLVK GRG | 8 |
| GLP-1, frog | HAEGTYTNDVTEYLEEKAAKEFIEWL IKGKPKKIRYS | 9 |
| Glucagon-like peptide 2 (GLP-2), human | HADGSFSDEMNTILDNLAARDFINWL IETKITD | 10 |
| GLP-2, frog | HAEGTFTNDMTNYLEEKAAKEFVGWLIK GRP-OH | 11 |

"Amylin" means the human peptide hormone referred to as amylin, pramlintide, and species variations thereof, as described in U.S. Pat. No. 5,234,906, having at least a portion of the biological activity of native amylin. Amylin is a 37-amino acid polypeptide hormone co-secreted with insulin by pancreatic beta cells in response to nutrient intake (Koda et al., Lancet 339:1179-1180. 1992), and has been reported to modulate several key pathways of carbohydrate metabolism, including incorporation of glucose into glycogen. Amylin-containing fusion proteins of the invention may find particular use in diabetes and obesity for regulating gastric emptying, suppressing glucagon secretion and food intake, thereby affecting the rate of glucose appearance in the circulation. Thus, the fusion proteins may complement the action of insulin, which regulates the rate of glucose disappearance from the circulation and its uptake by peripheral tissues. Amylin analogues have been cloned, as described in U.S. Pat. Nos. 5,686,411 and 7,271,238. Amylin mimetics can be created that retain biologic activity. For example, pramlintide has the sequence KCNTATCATNRLANFLVHSSNNFG-PILPPTNVGSNTY (SEQ ID NO: 12), wherein amino acids from the rat amylin sequence are substituted for amino acids in the human amylin sequence. In one embodiment, the invention contemplates fusion proteins comprising amylin mimetics of the sequence
KCNTATCATX$_1$RLANFLVHSSNNFGX$_2$ILX$_2$X$_2$TN-VGSNTY (SEQ ID NO: 13)
wherein X$_1$ is independently N or Q and X$_2$ is independently S, P or G. In one embodiment, the amylin mimetic incorporated into a GPXTEN has the sequence KCNTATCATNR-LANFLVHSSNNFGGILGGTNVGSNTY (SEQ ID NO: 14). In another embodiment, wherein the amylin mimetic is used at the C-terminus of the GPXTEN, the mimetic has the sequence KCNTATCATNRLANFLVHSSNNFGGILG-GTNVGSNTY(NH2) (SEQ ID NO: 15)

"Exendin-3" means a glucose regulating peptide isolated from *Heloderma horridum* and sequence variants thereof having at least a portion of the biological activity of native exendin-3. Exendin-3 amide is a specific exendin receptor antagonist from that mediates an increase in pancreatic cAMP, and release of insulin and amylase. Exendin-3-containing fusion proteins of the invention may find particular use in the treatment of diabetes and insulin resistance disorders. The sequence and methods for its assay are described in U.S. Pat. No. 5,424,286.

"Exendin-4" means a glucose regulating peptide found in the saliva of the Gila-monster *Heloderma suspectum*, as well as species and sequence variants thereof, and includes the native 39 amino acid sequence His-Gly-Glu-Gly-Thr-Phe-Thr-Ser-Asp-Leu-Ser-Lys-Gln-Met-Glu-Glu-Glu-Ala-Val-Arg-Leu-Phe-Ile-Glu-Trp-Leu-Lys-Asn-Gly-Gly-Pro-Ser-Ser-Gly-Ala-Pro-Pro-Pro-Ser (SEQ ID NO: 16) and homologous sequences and peptide mimetics, and variants thereof; natural sequences, such as from primates and non-natural having at least a portion of the biological activity of native exendin-4. Exendin-4 is an incretin polypeptide hormone that decreases blood glucose, promotes insulin secretion, slows gastric emptying and improves satiety, providing a marked improvement in postprandial hyperglycemia. The exendins have some sequence similarity to members of the glucagon-like peptide family, with the highest identity being to GLP-1 (Goke, et al., J. Biol. Chem., 268:19650-55 (1993)). A variety of homologous sequences can be functionally equivalent to native exendin-4 and GLP-1. Conservation of GLP-1 sequences from different species are presented in Regulatory Peptides 2001 98 p. 1-12. Table 2 shows the sequences from a wide variety of species, while Table 3 shows a list of synthetic GLP-1 analogs; all of which are contemplated for use as glucose regulating peptides in the GPXTEN described herein. Exendin-4 binds at GLP-1 receptors on insulin-secreting βPTC1 cells, and also stimulates somatostatin release and inhibits gastrin release in isolated stomachs (Goke, et al., *J. Biol. Chem.* 268:19650-55, 1993). As a mimetic of GLP-1, exendin-4 displays a similar broad range of biological activities, yet has a longer half-life than GLP-1, with a mean terminal half-life of 2.4 h. Exenatide is a synthetic version of exendin-4, marketed as Byetta. However, due to its short half-life, exenatide is currently dosed twice daily, limiting its utility. Exendin-4-containing fusion proteins of the invention may find particular use in the treatment of diabetes and insulin resistance disorders.

"Glucagon" means the human glucagon glucose regulating peptide, or species and sequence variants thereof, including the native 29 amino acid sequence and homologous sequences; natural, such as from primates, and non-natural sequence variants having at least a portion of the biological activity of native glucagon. The term "glucagon" as used herein also includes peptide mimetics of glucagon. Native glucagon is produced by the pancreas, released when blood glucose levels start to fall too low, causing the liver to convert stored glycogen into glucose and release it into the bloodstream. While the action of glucagon is opposite that of insulin, which signals the body's cells to take in glucose from the blood, glucagon also stimulates the release of insulin, so that newly-available glucose in the bloodstream can be taken up and used by insulin-dependent tissues. Glucagon-containing fusion proteins of the invention may find particular use in increasing blood glucose levels in individuals with extant hepatic glycogen stores and maintaining glucose homeostasis in diabetes. Glucagon has been cloned, as disclosed in U.S. Pat. No. 4,826,763.

"GLP-1" means human glucagon like peptide-1 and sequence variants thereof having at least a portion of the biological activity of native GLP-1. The term "GLP-1" includes human GLP-1(1-37), GLP-1(7-37), and GLP-1(7-36)amide. GLP-1 stimulates insulin secretion, but only during periods of hyperglycemia. The safety of GLP-1 compared to insulin is enhanced by this property and by the observation that the amount of insulin secreted is proportional to the magnitude of the hyperglycemia. The biological half-life of GLP-1(7-37)OH is a mere 3 to 5 minutes (U.S. Pat. No. 5,118,666). GLP-1-containing fusion proteins of the invention may find particular use in the treatment of diabetes and insulin-resistance disorders for glucose regulation. GLP-1 has been cloned and derivatives prepared, as described in U.S. Pat. No. 5,118,666. Non-limited examples of GLP-1 sequences from a wide variety of species are shown in Table 2, while Table 3 shows the sequences of a number of synthetic GLP-1 analogs; all of which are contemplated for use as glucose regulating peptides in the GPXTEN compositions described herein.

TABLE 2

Naturally GLP-1 Homologs

| Gene Name [Source] | Sequence | SEQ ID NO: |
|---|---|---|
| GLP-1 [frog] | HAEGTYTNDVTEYLEEKAAKEFIEW LIKGKPKKIRYS | 17 |
| GLP-1a [Xenopus laevis] | HAEGTFTSDVTQQLDEKAAKEFIDW LINGGPSKEIIS | 18 |
| GLP-1b [Xenopus laevis] | HAEGTYTNDVTEYLEEKAAKEFIIE WLIKGKPK | 19 |
| GLP-1c [Xenopus laevis] | HAEGTFTNDMTNYLEEKAAKEFVGWLI KGRPK | 20 |
| Gastric Inhibitory Polypeptide [Mus musculus] | HAEGTFISDYSIAMDKIRQQDFVNWLL | 21 |
| Glucose-dependent insulinotropic polypeptide [Equus caballus] | HAEGTFISDYSIAMDKIRQQDFVNWLL | 22 |

TABLE 2-continued

Naturally GLP-1 Homologs

| Gene Name [Source] | Sequence | SEQ ID NO: |
|---|---|---|
| Glucagon-like peptide [Petromyzon marinus] | HADGTFTNDMTSYLDAKAARDFVSWLA RSDKS | 23 |
| Glucagon-like peptide [Anguilla rostrata] | HAEGTYTSDVSSYLQDQAAKEFVSWLK TGR | 24 |
| Glucagon-like peptide [Anguilla anguilla] | HAEGTYTSDVSSYLQDQAAKEFVSWLK TGR | 25 |
| Glucagon-like peptide [Hydrolagus colliei] | HADGIYTSDVASLTDYLKSKRFVESLS NYNKRQNDRRM | 26 |
| Glucagon-like peptide [Amia calva] | YADAPYISDVYSYLQDQVAKKWLKSGQ DRRE | 27 |
| GLUC_ICTPU/38-65 | HADGTYTSDVSSYLQEQAAKDFITWLKS | 28 |
| GLUCL_ANGRO/1-28 | HAEGTYTSDVSSYLQDQAAKEFVSWLKT | 29 |
| GLUC_BOVIN/98-125 | HAEGTFTSDVSSYLEGQAAKEFIAWLVK | 30 |
| GLUC1_LOPAM/91-118 | HADGTFTSDVSSYLKDQAIKDFVDRLKA | 31 |
| GLUCL_HYDCO/1-28 | HADGIYTSDVASLTDYLKSKRFVESLSN | 32 |
| GLUC_CAVPO/53-80 | HSQGTFTSDYSKYLDSRRAQQFLKWLLN | 33 |
| GLUC_CHIBR/1-28 | HSQGTFTSDYSKHLDSRYAQEFVQWLMN | 34 |
| GLUC1_LOPAM/53-80 | HSEGTFSNDYSKYLEDRKAQEFVRWLMN | 35 |
| GLUC_HYDCO/1-28 | HTDGIFSSDYSKYLDNRRTKDFVQWLLS | 36 |
| GLUC_CALM1/1-28 | HSEGTFSSDYSKYLDSRRAKDFVQWLMS | 37 |
| GIP_BOVIN/1-28 | YAEGTFISDYSIAMDKIRQQDFVNWLLA | 38 |
| VIP_MELGA/89-116 | HADGIFTTVYSHLLAKLAVKRYLHSLIR | 39 |
| PACA_CHICK/131-158 | HIDGIFTDSYSRYRKQMAVKKYLAAVLG | 40 |
| VIP_CAVPO/45-72 | HSDALFTDTYTRLRKQMAMKKYLNSVLN | 41 |
| VIP_DIDMA/1-28 | HSDAVFTDSYTRLLKQMAMRKYLDSILN | 42 |
| EXE1_HELSU/1-28 | HSDATFTAEYSKLLAKLALQKYLESILG | 43 |
| SLIB_CAPHI/1-28 | YADAIFTNSYRKVLGQLSARKLLQDIMN | 44 |
| SLIB_RAT/31-58 | HADAIFTSSYRRILGQLYARKLLHEIMN | 45 |
| SLIB_MOUSE/31-58 | HVDAIFTTNYRKLLSQLYARKVIQDIMN | 46 |
| PACA_HUMAN/83-110 | VAHGILNEAYRKVLDQLSAGKHLQSLVA | 47 |
| PACA_SHEEP/83-110 | VAHGILDKAYRKVLDQLSARRYLQTLMA | 48 |
| PACA_ONCNE/82-109 | HADGMFNKAYRKALGQLSARKYLHSLMA | 49 |
| GLUC_BOVIN/146-173 | HADGSFSDEMNTVLDSLATRDFINWLLQ | 50 |
| SECR_CANFA/1-27 | HSDGTFTSELSRLRESARLQRLLQGLV | 51 |

TABLE 2-continued

Naturally GLP-1 Homologs

| Gene Name [Source] | Sequence | SEQ ID NO: |
|---|---|---|
| SECR_CHICK/1-27 | HSDGLFTSEYSKMRGNAQVQKFIQNLM | 52 |
| EXE3_HELHO/48-75 | HSDGTFTSDLSKQMEEEAVRLFIEWLKN | 53 |

GLP native sequences may be described by several sequence motifs, which are presented below. Letters in brackets represent acceptable amino acids at each sequence position: [HVY] [AGISTV] [DEHQ] [AG] [ILMPSTV] [FLY] [DINST] [ADEKNST] [ADENSTV] [LMVY] [ANRSTY] [EHIKNQRST] [AHILMQVY] [LMRT] [ADEGKQS] [ADEGKNQSY] [AEIKLMQR] [AKQRSVY] [AILMQSTV] [GKQR] [DEKLQR] [FHLVWY] [ILV] [ADEGPIKNQRSTW] [ADEGNRSTW] [GILVW] [AIKLMQSV] [ADGIKNQRST] [GKRSY]. In addition, synthetic analogs of GLP-1 and pramlintide can be useful as fusion partners to XTEN to create GPXTEN with biological activity useful in treatment of glucose-related disorders. Non-limited examples of synthetic GLP-1 and pramlintide sequences can be found in Table 3. In addition, further sequences homologous to GLP-1, pramlintide, as well as sequences homologous to exendin-4, amylin, or glucagon may be found by standard homology searching techniques.

TABLE 3

GLP-1 and pramlintide synthetic analogs

| Analog Sequence | SEQ ID NO: |
|---|---|
| HAEGTFTSDVSSYLEGQAAREFIAWLVKGRG | 54 |
| HAEGTFTSDVSSYLEGQAAKEFIAWLVRGRG | 55 |
| HAEGTFTSDVSSYLEGQAAKEFIAWLVKGKG | 56 |
| HAEGTFTSDVSSYLEGQAAREFIAWLVRGKG | 57 |
| HAEGTFTSDVSSYLEGQAAREFIAWLVRGKGR | 58 |
| HAEGTFTSDVSSYLEGQAAREFIAWLVRGRK | 59 |
| HAEGTFTSDVSSYLEGQAAREFIAWLVRGRRK | 60 |
| HAEGTFTSDVSSYLEGQAAREFIAWLVKGKG | 61 |
| HAEGTFTSDVSSYLEGQAAREFIAWLVKGKG | 62 |
| HAEGTFTSDVSSYLEGQAAREFIAWLVKGRGK | 63 |
| HAEGTFTSDVSSYLEGQAAKEFIAWLVRGRRK | 64 |
| HAEGTFTSDVSSYLEGQAAREFIAWLVKGKGRK | 65 |
| HAEGTFTSDVSSYLEGQAAREFIAWLVKGKGRRK | 66 |
| HGEGTFTSDVSSYLEGQAAREFIAWLVKGRG | 67 |
| HGEGTFTSDVSSYLEGQAAKEFIAWLVRGRG | 68 |
| HGEGTFTSDVSSYLEGQAAKEFIAWLVKGKG | 69 |
| HGEGTFTSDVSSYLEGQAAREFIAWLVRGKG | 70 |
| HGEGTFTSDVSSYLEGQAAREFIAWLVRGRK | 71 |
| HGEGTFTSDVSSYLEGQAAREFIAWLVRGRRK | 72 |

TABLE 3-continued

GLP-1 and pramlintide synthetic analogs

| Analog Sequence | SEQ ID NO: |
|---|---|
| HGEGTFTSDVSSYLEGQAAREFIAWLVKGKG | 73 |
| HGEGTFTSDVSSYLEGQAAKEFIAWLVRGKG | 74 |
| HGEGTFTSDVSSYLEGQAAREFIAWLVKGRGRK | 75 |
| HGEGTFTSDVSSYLEGQAAKEFIAWLVRGRRK | 76 |
| HGEGTFTSDVSSYLEGQAAREFIAWLVRGKGRK | 77 |
| HGEGTFTSDVSSYLEGQAAREFIAWLVRGKGRRK | 78 |
| HAEGTFTSDVSSYLEGQAAREFIAWLVRGRGK | 79 |
| HAEGTFTSDVSSYLEGQAAREFIAWLVRGRGRK | 80 |
| HAEGTFTSDVSSYLEGQAAREFIAWLVRGRGRRK | 81 |
| HAEGTFTSDVSSYLEGQAAREFIAWLVRGRGRREK | 82 |
| HAEGTFTSDVSSYLEGQAAREFIAWLVRGRGRREFK | 83 |
| HAEGTFTSDVSSYLEGQAAREFIAWLVRGRGRREFPK | 84 |
| HAEGTFTSDVSSYLEGQAAREFIAWLVRGRGRREFPEK | 85 |
| HAEGTFTSDVSSYLEGQAAREFIAWLVRGRGRREFPEEK | 86 |
| HDEFERHAEGTFTSDVSSYLEGQAAREFIAWLVRGRGK | 87 |
| HDEFERHAEGTFTSDVSSYLEGQAAREFIAWLVRGRGRK | 88 |
| HDEFERHAEGTFTSDVSSYLEGQAAREFIAWLVRGRGRRK | 89 |
| HDEFERHAEGTFTSDVSSYLEGQAAREFIAWLVRGRGRREK | 90 |
| HDEFERHAEGTFTSDVSSYLEGQAAREFIAWLVRGRGRREFK | 91 |
| HDEFERHAEGTFTSDVSSYLEGQAAREFIAWLVRGRGRREFPK | 92 |
| HDEFERHAEGTFTSDVSSYLEGQAAREFIAWLVRGRGRREFPEK | 93 |
| HDEFERHAEGTFTSDVSSYLEGQAAREFIAWLVRGRGRREFPEEK | 94 |
| DEFERHAEGTFTSDVSSYLEGQAAREFIAWLVRGRGK | 95 |
| DEFERHAEGTFTSDVSSYLEGQAAREFIAWLVRGRGRRK | 96 |
| DEFERHAEGTFTSDVSSYLEGQAAREFIAWLVRGRGRREK | 97 |
| DEFERHAEGTFTSDVSSYLEGQAAREFIAWLVRGRGRREFK | 98 |
| DEFERHAEGTFTSDVSSYLEGQAAREFIAWLVRGRGRREFPK | 99 |
| DEFERHAEGTFTSDVSSYLEGQAAREFIAWLVRGRGRREFPEK | 100 |
| DEFERHAEGTFTSDVSSYLEGQAAREFIAWLVRGRGRREFPEEK | 101 |
| EFERHAEGTFTSDVSSYLEGQAAREFIAWLVRGRGK | 102 |
| EFERHAEGTFTSDVSSYLEGQAAREFIAWLVRGRGRK | 103 |
| EFERHAEGTFTSDVSSYLEGQAAREFIAWLVRGRGRRK | 104 |
| EFERHAEGTFTSDVSSYLEGQAAREFIAWLVRGRGRREK | 105 |
| EFERHAEGTFTSDVSSYLEGQAAREFIAWLVRGRGRREFK | 106 |
| EFERHAEGTFTSDVSSYLEGQAAREFIAWLVRGRGRREFPK | 107 |
| EFERHAEGTFTSDVSSYLEGQAAREFIAWLVRGRGRREFPEK | 108 |
| EFERHAEGTFTSDVSSYLEGQAAREFIAWLVRGRGRREFPEEK | 109 |
| FERHAEGTFTSDVSSYLEGQAAREFIAWLVRGRGK | 110 |

TABLE 3-continued

GLP-1 and pramlintide synthetic analogs

| Analog Sequence | SEQ ID NO: |
|---|---|
| FERHAEGTFTSDVSSYLEGQAAREFIAWLVRGRGRK | 111 |
| FERHAEGTFTSDVSSYLEGQAAREFIAWLVRGRGRRK | 112 |
| FERHAEGTFTSDVSSYLEGQAAREFIAWLVRGRGRREK | 113 |
| FERHAEGTFTSDVSSYLEGQAAREFIAWLVRGRGRREFK | 114 |
| FERHAEGTFTSDVSSYLEGQAAREFIAWLVRGRGRREFPK | 115 |
| FERHAEGTFTSDVSSYLEGQAAREFIAWLVRGRGRREFPEK | 116 |
| FERHAEGTFTSDVSSYLEGQAAREFIAWLVRGRGRREFPEEK | 117 |
| ERHAEGTFTSDVSSYLEGQAAREFIAWLVRGRGK | 118 |
| ERHAEGTFTSDVSSYLEGQAAREFIAWLVRGRGRK | 119 |
| ERHAEGTFTSDVSSYLEGQAAREFIAWLVRGRGRRK | 120 |
| ERHAEGTFTSDVSSYLEGQAAREFIAWLVRGRGRREK | 121 |
| ERHAEGTFTSDVSSYLEGQAAREFIAWLVRGRGRREFK | 122 |
| ERHAEGTFTSDVSSYLEGQAAREFIAWLVRGRGRREFPK | 123 |
| ERHAEGTFTSDVSSYLEGQAAREFIAWLVRGRGRREFPEK | 124 |
| ERHAEGTFTSDVSSYLEGQAAREFIAWLVRGRGRREFPEEK | 125 |
| RHAEGTFTSDVSSYLEGQAAREFIAWLVRGRGK | 126 |
| RHAEGTFTSDVSSYLEGQAAREFIAWLVRGRGRK | 127 |
| RHAEGTFTSDVSSYLEGQAAREFIAWLVRGRGRRK | 128 |
| RHAEGTFTSDVSSYLEGQAAREFIAWLVRGRGRREK | 129 |
| RHAEGTFTSDVSSYLEGQAAREFIAWLVRGRGRREFK | 130 |
| RHAEGTFTSDVSSYLEGQAAREFIAWLVRGRGRREFPK | 131 |
| RHAEGTFTSDVSSYLEGQAAREFIAWLVRGRGRREFPEK | 132 |
| RHAEGTFTSDVSSYLEGQAAREFIAWLVRGRGRREFPEEK | 133 |
| HDEFERHAEGTFTSDVSSYLEGQAAREFIAWLVKGRGK | 134 |
| HDEFERHAEGTFTSDVSSYLEGQAAKEFIAWLVRGRGK | 135 |
| HDEFERHAEGTFTSDVSSYLEGQAAREFIAWLVRGKGK | 136 |
| HAEGTFTSDVSSYLEGQAAREFIAWLVKGRGK | 137 |
| HAEGTFTSDVSSYLEGQAAKEFIAWLVRGRGK | 138 |
| HAEGTFTSDVSSYLEGQAAREFIAWLVRGKGK | 139 |
| HAEGTFTSDVSSYLEGQAAREFIAWLVRGRGK | 140 |
| HDEFERHAEGTFTSDVSSYLEGQAAREFIAWLVKGRGRK | 141 |
| HDEFERHAEGTFTSDVSSYLEGQAAKEFIAWLVRGRGRK | 142 |
| HDEFERHAEGTFTSDVSSYLEGQAAREFIAWLVRGKGRK | 143 |
| HAEGTFTSDVSSYLEGQAAREFIAWLVKGRGRK | 144 |
| HAEGTFTSDVSSYLEGQAAKEFIAWLVRGRGRK | 145 |
| HAEGTFTSDVSSYLEGQAAREFIAWLVRGKGRK | 146 |
| HGEGTFTSDVSSYLEGQAAREFIAWLVKGRGK | 147 |
| HGEGTFTSDVSSYLEGQAAREFIAWLVRGKGK | 148 |
| KCNTATCATNRLANFLVHSSNNFGPILPPTNVGSNTY | 149 |
| KCNTATCATNRLANFLVHSSNNFGGILPPTNVGSNTY | 150 |
| KCNTATCATNRLANFLVHSSNNFGPILGPTNVGSNTY | 151 |
| KCNTATCATNRLANFLVHSSNNFGPILPGTNVGSNTY | 152 |
| KCNTATCATNRLANFLVHSSNNFGGILGPTNVGSNTY | 153 |
| KCNTATCATNRLANFLVHSSNNFGPILGGTNVGSNTY | 154 |
| KCNTATCATNRLANFLVHSSNNFGGILPGTNVGSNTY | 155 |
| KCNTATCATNRLANFLVHSSNNFGGILGGTNVGSNTY | 156 |

"GLP-2" means human glucagon like peptide-2 and sequence variants thereof having at least a portion of the biological activity of native GLP-2. More particularly, GLP-2 is a 33 amino acid peptide, co-secreted along with GLP-1 from intestinal endocrine cells in the small and large intestine.

III) Glucose Regulating Peptide Fusion Protein Compositions

The present invention relates in part to fusion protein compositions comprising glucose regulating peptides (GP). In one aspect, the invention provides isolated monomeric fusion proteins of GP comprising the full-length sequence or sequence variants of GP covalently linked to extended recombinant polypeptides ("XTEN" or "XTENs"). As described more fully below, the fusion proteins can optionally include spacer sequences that further comprise cleavage sequences to release the GP from the fusion protein when acted on by a protease, releasing GP from the XTEN sequence(s).

In some cases, the invention provides an isolated fusion protein comprising at least a first biologically active glucose regulating peptide covalently linked to one or more extended recombinant polypeptides ("XTEN"), resulting in a glucose regulating peptide-XTEN fusion protein composition (hereinafter "GPXTEN"). In other cases, the glucose regulating peptide linked to one or more XTEN is inactive or has reduced activity that can optionally include spacer sequences that can further comprise cleavage sequences to release the GP from the fusion protein when acted on by a protease in a more active form.

The term "GPXTEN", as used herein, is meant to encompass fusion polypeptides that comprise one or more payload regions each comprising a biologically active GP that mediates one or more biological or therapeutic activities associated with a glucose regulating peptide and at least one other region comprising at least a first XTEN polypeptide that serves as a carrier.

The GP of the subject compositions, particularly those disclosed in Table 1, together with their corresponding nucleic acid and amino acid sequences, are well known in the art and descriptions and sequences are available in public databases such as Chemical Abstracts Services Databases (e.g., the CAS Registry), GenBank, The Universal Protein Resource (UniProt) and subscription provided databases such as GenSeq (e.g., Derwent). Polynucleotide sequences may be a wild type polynucleotide sequence encoding a given GP (e.g., either full length or mature), or in some instances the sequence may be a variant of the wild type polynucleotide sequence (e.g., a polynucleotide which encodes the wild type biologically active protein, wherein the DNA sequence of the polynucleotide has been optimized, for example, for expression in a particular species; or a polynucleotide encoding a variant of the wild type protein, such as a site directed mutant or an allelic variant. It is well within the ability of the skilled artisan to use a wild-type or consensus cDNA sequence or a codon-optimized variant of a GP to create GPXTEN constructs contemplated by the invention using methods known in the art and/or in conjunction with the guidance and methods provided herein, and described more fully in the Examples.

The GP for inclusion in the GPXTEN of the invention include any glucose regulating peptide or sequence variant of biologic, therapeutic, prophylactic, or diagnostic interest or function, or that is useful for mediating or preventing or ameliorating a disease, disorder or condition associated with a glucose regulating peptide deficiency or a defect in sensitivity to one or more GP by the subject. Of particular interest are GPXTEN fusion protein compositions for which an increase in a pharmacokinetic parameter, increased solubility, increased stability, or some other enhanced pharmaceutical property compared to native GP is sought, or for which increasing the terminal half-life would improve efficacy, safety, or result in reduce dosing frequency and/or improve patient compliance. Thus, the GPXTEN fusion protein compositions are prepared with various objectives in mind, including improving the therapeutic efficacy of the bioactive GP by, for example, increasing the in vivo exposure or the length that the GPXTEN remains within the therapeutic window when administered to a subject, compared to a GP not linked to XTEN.

In one embodiment, the GP incorporated into the subject compositions can be a recombinant polypeptide with a sequence corresponding to a protein found in nature. In another embodiment, the GP can be sequence variants, fragments, homologs, and mimetics of a natural sequence that retain at least a portion of the biological activity of the native GP. In some cases, the GP for incorporation into the GPXTEN of the invention can be a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity to a protein sequence selected from the sequences of Table 1, Table 2 and Table 3. In one embodiment, a GPXTEN fusion protein can comprise a single GP molecule linked to an XTEN (as described more fully below). In another embodiment, the GPXTEN can comprise a first GP and a second molecule of the same GP, resulting in a fusion protein comprising the two GP linked to one or more XTEN (for example, two molecules of GLP-1). In another embodiment, the GPXTEN fusion protein can comprise a single GP molecule linked to a first and a second XTEN, with an N- to C-terminus configuration of XTEN-GP-XTEN, in which the GP can be a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity to a sequence selected from the sequences of Table 1, Table 2 and Table 3, and the first and/or the second XTEN can be sequences that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity to a sequence selected from the sequence of Table 5.

In general, the GP fusion partner component of the GPXTEN will exhibit a binding specificity to a given target or another desired biological characteristic when used in vivo or when utilized in an in vitro assay. For example, the GPXTEN can be an agonist, having the ability to bind to a cell receptor for a glucose regulating peptide. In one embodiment, the binding of GPXTEN to its receptor can lead to at least a portion of the activation of intercellular signal transduction pathway compared to the corresponding native glucose regulating peptide not linked to XTEN. In one embodiment, the GPXTEN bound to a cell receptor for a glucose regulating peptide can exhibit at least about 1%, or about 5%, or about 10%, or about 15%, or about 20%, or about 25%, or about 30%, or about 40%, or about 50%, or about 60%, or about 70%, or about 80%, or about 90%, or at least about 95% of the activation of intercellular signal transduction pathway compared to native glucose regulating peptide not linked to XTEN.

The subject GPXTEN of the present invention can exhibit an enhancement of one or more pharmacokinetic parameters, which optionally could be enhanced for a biologic effect by release of GP from the fusion protein by cleavage of a spacer sequence. The GPXTEN with enhanced pharmacokinetic parameters would permit less frequent dosing or an enhanced pharmacologic effect, such as but not limited to maintaining the biologically active GPXTEN within the therapeutic window between the minimum effective dose or blood concentration ($C_{min}$) and the maximum tolerated dose or blood concentration ($C_{max}$). In such cases, the linking of the GP to a fusion protein comprising a select XTEN sequence(s) can result in an improvement in these properties, making them more useful as therapeutic or preventive agents compared to GP not linked to XTEN.

IV) Xtended Recombinant Polypeptides

In one aspect, the invention provides XTEN polypeptide compositions that are useful as a fusion protein partner to which GP is linked, resulting in a GPXTEN fusion protein. XTEN are generally extended length polypeptides with non-naturally occurring, substantially non-repetitive sequences that are composed mainly of small hydrophilic amino acids, with the sequence having a low degree or no secondary or tertiary structure under physiologic conditions.

XTENs can have utility as a fusion protein partners partner in that they can serve as a "carrier", conferring certain desirable pharmacokinetic, physicochemical and pharmaceutical properties when linked to a GP protein to a create a fusion protein. Such desirable properties include but are not limited to enhanced pharmacokinetic parameters and solubility characteristics of the compositions, amongst other properties described below. Such fusion protein compositions have utility to treat certain glucose regulating peptide-related diseases, disorders or conditions, as described herein. As used herein, "XTEN" specifically excludes antibodies or antibody fragments such as single-chain antibodies or Fc fragments of a light chain or a heavy chain.

In some embodiments, XTEN are long polypeptides having greater than about 100 to about 3000 amino acid residues, preferably greater than 400 to about 3000 residues when used as a carrier or cumulatively when more than one XTEN unit is used in a single fusion protein. In other cases, when used as a linker between fusion protein components or where an increase in half-life of the fusion protein is not needed but where an increase in solubility or other physicochemical property for the GP fusion partner component is desired, an XTEN sequence shorter than 100 amino acid residues, such as about 96, or about 84, or about 72, or about 60, or about 48, or about 36 amino acid residues may be incorporated into a fusion protein composition with the GP to effect the property.

The selection criteria for the XTEN to be linked to the biologically active proteins used to create the inventive fusion proteins compositions generally relate to attributes of physical/chemical properties and conformational structure of the XTEN that can be, in turn, used to confer enhanced pharmaceutical and pharmacokinetic properties to the fusion protein compositions. The XTEN of the present invention may exhibit one or more of the following advantageous properties: conformational flexibility, enhanced aqueous solubility, high degree of protease resistance, low immunogenicity, low binding to mammalian receptors, and increased hydrodynamic (or Stokes) radii; properties that can make them particularly useful as fusion protein partners. Non-limiting examples of the properties of the fusion proteins comprising GP that may be enhanced by XTEN include increases in the overall solubility and/or metabolic stability, reduced susceptibility to proteolysis, reduced immunogenicity, reduced rate of absorption when administered subcutaneously or intramuscularly, and enhanced pharmacokinetic properties such as longer terminal half-life and increased area under the curve (AUC), slower absorption after subcutaneous or intramuscular injection compared to GP not linked to XTEN and administered by a similar route such that the $C_{max}$ is lower, which may, in turn, result in reductions in adverse effects of the GP that, collectively with increased half-life and/or AUC, can result in an increased period of time that a fusion protein of a GPXTEN composition administered to a subject retains therapeutic activity.

A variety of methods and assays are known in the art for determining the physicaUchemical properties of proteins such as the compositions comprising the inventive XTEN; properties such as solubility, secondary or tertiary structure, solubility, protein aggregation, melting properties, contamination and water content. Such methods include analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UVNisible spectroscopy. Additional methods are disclosed in Arnau et al., Prot Expr and Purif (2006) 48, 1-13. Application of these methods to the invention would be within the grasp of a person skilled in the art.

Typically, XTEN are designed to behave like denatured peptide sequences under physiological conditions, despite the extended length of the polymer. Denatured describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD) spectra and are characterized by a lack of long-range interactions as determined by NMR. "Denatured conformation" and "unstructured conformation" are used synonymously herein. In some cases, the invention provides XTEN sequences that, under physiologic conditions, can resemble denatured sequences largely devoid in secondary structure. In other cases, the XTEN sequences can be substantially devoid of secondary structure under physiologic conditions. "Largely devoid," as used in this context, means that less than 50% of the XTEN amino acid residues of the XTEN sequence contribute to secondary structure as measured or determined by the means described herein. "Substantially devoid," as used in this context, means that at least about 60%, or about 70% or about 80%, or about 90%, or about 95%, or at least about 99% of the XTEN amino acid residues of the XTEN sequence do not contribute to secondary structure, as measured or determined by the means described herein.

A variety of methods have been established in the art to discern the presence or absence of secondary and tertiary structures in a given polypeptide. In particular, secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra. Secondary structure can also be predicted for a polypeptide sequence via certain computer programs or algorithms, such as the well-known Chou-Fasman algorithm (Chou, P.Y., et al. (1974) *Biochemistry*, 13: 222-45) and the Garnier-Osguthorpe-Robson ("GOR") algorithm (Garnier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In some cases, the XTEN sequences used in the inventive fusion protein compositions can have an alpha-helix percentage ranging from 0% to less than about 5% as determined by a Chou-Fasman algorithm. In other cases, the XTEN sequences of the fusion protein compositions can have a beta-sheet percentage ranging from 0% to less than about 5% as determined by a Chou-Fasman algorithm. In some cases, the XTEN sequences of the fusion protein compositions can have an alpha-helix percentage ranging from 0% to less than about 5% and a beta-sheet percentage ranging from 0% to less than about 5% as determined by a Chou-Fasman algorithm. In preferred embodiments, the XTEN sequences of the fusion protein compositions will have an alpha-helix percentage less than about 2% and a beta-sheet percentage less than about 2%. In other cases, the XTEN sequences of the fusion protein compositions can have a high degree of random coil percentage, as determined by a GOR algorithm. In some embodiments, an XTEN sequence can have at least about 80%, or at least about 90%, or at least about 91%, or at least about 92%, or at least about 93%, or at least about 94%, or at least about 95%, or at least about 96%, or at least about 97%, or at least about 98%, and most preferably at least about 99% random coil, as determined by a GOR algorithm.

1. Non-Repetitive Sequences

XTEN sequences of the subject compositions can be substantially non-repetitive. In general, repetitive amino acid sequences have a tendency to aggregate or form higher order structures, as exemplified by natural repetitive sequences such as collagens and leucine zippers, or form contacts resulting in crystalline or pseudocrystaline structures. In contrast, the low tendency of non-repetitive sequences to aggregate enables the design of long-sequence XTENs with a relatively low frequency of charged amino acids that would be likely to aggregate if the sequences were otherwise repetitive. Typically, the GPXTEN fusion proteins comprise XTEN sequences of greater than about 100 to about 3000 amino acid residues, preferably greater than 400 to about 3000 cumulative residues, wherein the sequences are substantially non-repetitive. In one embodiment, the XTEN sequences can have greater than about 100 to about 3000 amino acid residues in which no three contiguous amino acids in the sequence are identical amino acid types unless the amino acid is serine, in which case no more than three contiguous amino acids are serine residues. In the foregoing embodiment, the XTEN sequence would be substantially non-repetitive.

The degree of repetitiveness of a polypeptide or a gene can be measured by computer programs or algorithms or by other means known in the art. Repetitiveness in a polypeptide sequence can, for example, be assessed by determining the number of times shorter sequences of a given length occur within the polypeptide. For example, a polypeptide of 200 amino acid residues has 192 overlapping 9-amino acid sequences (or 9-mer "frames") and 198 3-mer frames, but the number of unique 9-mer or 3-mer sequences will depend on the amount of repetitiveness within the sequence. A score can be generated (hereinafter "subsequence score") that is reflective of the degree of repetitiveness of the subsequences in the overall polypeptide sequence. In the context of the present invention, "subsequence score" means the sum of occurrences of each unique 3-mer frame across a 200 consecutive amino acid sequence of the polypeptide divided by the absolute number of unique 3-mer subsequences within the 200 amino acid sequence. Examples of such subsequence scores derived from the first 200 amino acids of repetitive and non-repetitive polypeptides are presented in Example 40. In some embodiments, the present invention provides GPXTEN each comprising one or more XTEN in which the XTEN can have a subsequence score less than 12, more preferably less than 10, more preferably less than 9, more preferably less than 8, more preferably less than 7, more preferably less than 6, and most preferably less than 5 when derived from a segment of 200 contiguous amino acid residues. In the embodiments hereinabove described in this paragraph, an XTEN with a subsequence score less than about 10 (i.e., 9, 8, 7, etc.) would be "substantially non-repetitive."

The non-repetitive characteristic of XTEN can impart to fusion proteins with GP a greater degree of solubility and less tendency to aggregate compared to polypeptides having repetitive sequences. These properties can facilitate the formulation of XTEN-comprising pharmaceutical preparations containing extremely high drug concentrations, in some cases exceeding 100 mg/ml.

Furthermore, the XTEN polypeptide sequences of the embodiments are designed to have a low degree of internal repetitiveness in order to reduce or substantially eliminate immunogenicity when administered to a mammal. Polypeptide sequences composed of short, repeated motifs largely limited to three amino acids, such as glycine, serine and glutamate, may result in relatively high antibody titers when administered to a mammal despite the absence of predicted T-cell epitopes in these sequences. This may be caused by the repetitive nature of polypeptides, as it has been shown that immunogens with repeated epitopes, including protein aggregates, cross-linked immunogens, and repetitive carbohydrates are highly immunogenic and can, for example, result in the cross-linking of B-cell receptors causing B-cell activation. (Johansson, J., et al. (2007) Vaccine, 25:1676-82; Yankai, Z., et al. (2006) Biochem Biophys Res Commun, 345:1365-71; Hsu, C. T., et al. (2000) Cancer Res, 60:3701-5); Bachmann M F, et al. Eur J Immunol. (1995) 25(12):3445-3451).

2. Exemplary Sequence Motifs

The present invention encompasses XTEN that can comprise multiple units of shorter sequences, or motifs, in which the amino acid sequences of the motifs are non-repetitive. In designing XTEN sequences, it was discovered that the non-repetitive criterion may be met despite the use of a "building block" approach using a library of sequence motifs that are multimerized to create the XTEN sequences. Thus, while an XTEN sequence may consist of multiple units of as few as four different types of sequence motifs, because the motifs themselves generally consist of non-repetitive amino acid sequences, the overall XTEN sequence is rendered substantially non-repetitive.

In one embodiment, XTEN can have a non-repetitive sequence of greater than about 100 to about 3000 amino acid residues, or greater than 400 to about 3000 residues, wherein at least about 80%, or at least about 85%, or at least about 90%, or at least about 95%, or at least about 97%, or about 100% of the XTEN sequence consists of non-overlapping sequence motifs, wherein each of the motifs has about 9 to 36 amino acid residues. In other embodiments, at least about 80%, or at least about 85%, or at least about 90%, or at least about 95%, or at least about 97%, or about 100% of the XTEN sequence consists of non-overlapping sequence motifs wherein each of the motifs has 9 to 14 amino acid residues. In still other embodiments, at least about 80%, or at least about 85%, or at least about 90%, or at least about 95%, or at least about 97%, or about 100% of the XTEN sequence component consists of non-overlapping sequence motifs wherein each of the motifs has 12 amino acid residues. In these embodiments, it is preferred that the sequence motifs be composed mainly of small hydrophilic amino acids, such that the overall sequence has an unstructured, flexible characteristic. Examples of amino acids that can be included in XTEN, are, e.g., arginine, lysine, threonine, alanine, asparagine, glutamine, aspartate, glutamate, serine, and glycine. As a result of testing variables such as codon optimization, assembly polynucleotides encoding sequence motifs, expression of protein, charge distribution and solubility of expressed protein, and secondary and tertiary structure, it was discovered that XTEN compositions with enhanced characteristics mainly include glycine (G), alanine (A), serine (S), threonine (T), glutamate (E) and proline (P) residues wherein the sequences are designed to be substantially non-repetitive. In a preferred embodiment, XTEN sequences have predominately four to six types of amino acids selected from glycine (G), alanine (A), serine (S), threonine (T), glutamate (E) or proline (P) that are arranged in a substantially non-repetitive sequence that is greater than about 100 to about 3000 amino acid residues, or greater than 400 to about 3000 residues in length. In some embodiments, XTEN can have sequences of greater than about 100 to about 3000 amino acid residues, or greater than 400 to about 3000 residues, wherein at least about 80% of the sequence consists of non-overlapping sequence motifs wherein each of the motifs has 9 to 36 amino acid residues wherein each of the motifs consists of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 9 to 36 amino acid residues wherein the motifs consist of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 12 amino acid residues consisting of 4 to 6 types of amino acids selected from glycine (G), alanine (A), serine (S), threonine (T), glutamate (E) and proline (P), and wherein the content of any one amino acid type in the full-length XTEN does not exceed 30%. In yet other embodiments, at least about 90%, or about 91%, or about 92%, or about 93%, or about 94%, or about 95%, or about 96%, or about 97%, or about 98%, or about 99%, to about 100% of the XTEN sequence consists of non-overlapping sequence motifs wherein each of the motifs has 12 amino acid residues consisting of glycine (G), alanine (A), serine (S), threonine (T), glutamate (E) and proline (P), and wherein the content of any one amino acid type in the full-length XTEN does not exceed 30%.

In still other embodiments, XTENs comprise non-repetitive sequences of greater than about 100 to about 3000 amino acid residues, or greater than 400 to about 3000 amino acid residues wherein at least about 80%, or at least about 90%, or about 91%, or about 92%, or about 93%, or about 94%, or about 95%, or about 96%, or about 97%, or about 98%, or about 99% of the sequence consists of non-overlapping sequence motifs of 9 to 14 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one motif is not repeated more than twice in the sequence motif. In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of 4 to 6 types of amino acids selected from glycine (G), alanine (A), serine (S), threonine (1), glutamate (E) and proline (P), and wherein the sequence of any two contiguous amino acid residues in any one sequence motif is not repeated more than twice in the sequence motif. In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of glycine (G), alanine (A), serine (S), threonine (T), glutamate (E) and proline (P), and wherein the sequence of any two contiguous amino acid residues in any one sequence motif is not repeated more than twice in the sequence motif. In yet other embodiments, XTENs consist of 12 amino acid sequence motifs wherein the amino acids are selected from glycine (G), alanine (A), serine (S), threonine (T), glutamate (E) and proline (P), and wherein the sequence of any two contiguous amino acid residues in any one sequence motif is not repeated more than twice in the sequence motif, and wherein the content of any one amino acid type in the full-length XTEN does not exceed 30%. In the foregoing embodiments hereinabove described in this paragraph, the XTEN sequences would be substantially non-repetitive.

In some cases, the invention provides compositions comprising non-repetitive XTEN sequence(s) of greater than about 100 to about 3000 amino acid residues, or of cumulatively greater than 400 to about 3000 residues, wherein at least about 80%, or at least about 90%, or about 91%, or about 92%, or about 93%, or about 94%, or about 95%, or about 96%, or about 97%, or about 98%, or about 99% to about 100% of the sequence consists of multiple units of two or more non-overlapping sequence motifs selected from the amino acid sequences of Table 4. In some cases, the XTEN comprises non-overlapping sequence motifs in which about 80%, or at least about 90%, or about 91%, or about 92%, or about 93%, or about 94%, or about 95%, or about 96%, or about 97%, or about 98%, or about 99% to about 100% of the sequence consists of two or more non-overlapping sequences selected from a single motif family of Table 4, resulting in a "family" sequence in which the overall sequence remains substantially non-repetitive. Accordingly, in these embodiments, an XTEN sequence can comprise multiple units of non-overlapping sequence motifs of the AD motif family, or the AE motif family, or the AF motif family, or the AG motif family, or the AM motif family, or the AQ motif family, or the BC family, or the BD family of sequences of Table 4. In other cases, the XTEN comprises motif sequences from two or more of the motif families of Table 4.

TABLE 4

XTEN Sequence Motifs of 12
Amino Acids and Motif Families

| Motif Family* | MOTIF SEQUENCE | SEQ ID NO: |
|---|---|---|
| AD | GESPGGSSGSES | 157 |
| AD | GSEGSSGPGESS | 158 |
| AD | GSSESGSSEGGP | 159 |
| AD | GSGGEPSESGSS | 160 |
| AE, AM | GSPAGSPTSTEE | 161 |
| AE, AM, AQ | GSEPATSGSETP | 162 |
| AE, AM, AQ | GTSESATPESGP | 163 |
| AE, AM, AQ | GTSTEPSEGSAP | 164 |
| AF, AM | GSTSESPSGTAP | 165 |
| AF, AM | GTSTPESGSASP | 166 |
| AF, AM | GTSPSGESSTAP | 167 |
| AF, AM | GSTSSTAESPGP | 168 |
| AG, AM | GTPGSGTASSSP | 169 |
| AG, AM | GSSTPSGATGSP | 170 |
| AG, AM | GSSPSASTGTGP | 171 |
| AG, AM | GASPGTSSTGSP | 172 |
| AQ | GEPAGSPTSTSE | 173 |
| AQ | GTGEPSSTPASE | 174 |
| AQ | GSGPSTESAPTE | 175 |
| AQ | GSETPSGPSETA | 176 |
| AQ | GPSETSTSEPGA | 177 |
| AQ | GSPSEPTEGTSA | 178 |
| BC | GSGASEPTSTEP | 179 |
| BC | GSEPATSGTEPS | 180 |
| BC | GTSEPSTSEPGA | 181 |
| BC | GTSTEPSEPGSA | 182 |
| BD | GSTAGSETSTEA | 183 |
| BD | GSETATSGSETA | 184 |
| BD | GTSESATSESGA | 185 |
| BD | GTSTEASEGSAS | 186 |

*Denotes individual motif sequences that, when used together in various permutations, results in a "family sequence"

In other cases, GPXTEN composition can comprise one or more non-repetitive XTEN sequences of greater than about 100 to about 3000 amino acid residues, or cumulatively greater than 400 to about 3000 residues, wherein at least about 80%, or at least about 90%, or about 91%, or about 92%, or about 93%, or about 94%, or about 95%, or about 96%, or about 97%, or about 98%, or about 99% to about 100% of the sequence consists of non-overlapping 36 amino acid sequence motifs selected from one or more of the polypeptide sequences of Tables 10-13.

In those embodiments wherein the XTEN component of the GPXTEN fusion protein has less than 100% of its amino acids consisting of four to six amino acid selected from glycine (G), alanine (A), serine (S), threonine (T), glutamate (E) and proline (P), or less than 100% of the sequence consisting of the sequence motifs of Table 4, or less than 100% sequence identity with an XTEN from Table 5, the other amino acid residues can be selected from any other of the 14 natural L-amino acids, but are preferentially selected from hydrophilic amino acids such that the XTEN sequence contains at least about 90%, or at least about 91%, or at least about 92%, or at least about 93%, or at least about 94%, or at least about 95%, or at least about 96%, or at least about 97%, or at least about 98%, or at least about 99% hydrophilic amino acids. The XTEN amino acids that are not glycine (G), alanine (A), serine (S), threonine (T), glutamate (E) and proline (P) are interspersed throughout the XTEN sequence, are located within or between the sequence motifs, or are concentrated in one or more short stretches of the XTEN sequence. In such cases where the XTEN component of the GPXTEN comprises amino acids other than glycine (G), alanine (A), serine (S), threonine (T), glutamate (E) and proline (P), it is preferred that the amino acids not be hydrophobic residues and should not substantially confer secondary structure of the XTEN component. Hydrophobic residues that are less favored in construction of XTEN include tryptophan, phenylalanine, tyrosine, leucine, isoleucine, valine, and methionine. Additionally, one can design the XTEN sequences to contain few (e.g. less than 5%) or none of the following amino acids: cysteine (to avoid disulfide formation and oxidation), methionine (to avoid oxidation), asparagine and glutamine (to avoid desamidation). Thus, in a preferred embodiment of the foregoing, the XTEN component of the GPXTEN fusion protein comprising other amino acids in addition to glycine (G), alanine (A), serine (S), threonine (T), glutamate (E) and proline (P) would have a sequence with less than 5% of the residues contributing to alpha-helices and beta-sheets as measured by the Chou-Fasman algorithm and would have at least 90%, or at least about 95% or more random coil formation as measured by the GOR algorithm.

3. Length of Sequence

In another aspect of the present invention, the invention encompasses GPXTEN compositions comprising carriers of XTEN polypeptides with extended length sequences. The present invention makes use of the discovery that increasing the length of non-repetitive, unstructured polypeptides enhances the unstructured nature of the XTENs and correspondingly enhances the biological and pharmacokinetic properties of fusion proteins comprising the XTEN carrier. As described more fully in the Examples, proportional increases in the length of the XTEN, even if created by a fixed repeat order of single family sequence motifs (e.g., the four AE motifs of Table 4), can result in a sequence with a higher percentage of random coil formation, as determined by GOR algorithm, compared to shorter XTEN lengths. In general, increasing the length of the unstructured polypeptide fusion partner can, as described in the Examples, results in a fusion protein with a disproportional increase in terminal half-life compared to fusion proteins with unstructured polypeptide partners with shorter sequence lengths.

Non-limiting examples of XTEN contemplated for inclusion in the GPXTEN of the invention are presented in Table 5. In one embodiment, the invention provides GPXTEN compositions wherein the XTEN sequence length of the fusion protein(s) is greater than about 100 to about 3000 amino acid residues, and in some cases is greater than 400 to about 3000 amino acid residues, wherein the XTEN confers enhanced pharmacokinetic properties on the GPXTEN in comparison to GP not linked to XTEN. In some cases, the XTEN sequences of the GPXTEN compositions of the present invention can be about 100, or about 144, or about 288, or about 401, or about 500, or about 600, or about 700, or about 800, or about 900, or about 1000, or about 1500, or about 2000, or about 2500 or up to about 3000 amino acid residues in length. In other cases, the XTEN sequences can be about 100 to 150, about 150 to 250, about 250 to 400, 401 to about 500, about 500 to 900, about 900 to 1500, about 1500 to 2000, or about 2000 to about 3000 amino acid residues in length. In one embodiment, the GPXTEN can comprise an XTEN sequence wherein the sequence exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a XTEN selected from Table 5. In some cases, the XTEN sequence is designed for optimized expression as the N-terminal component of the GPXTEN by inclusion of encoding nucleotides for an optimized N-terminal leader sequence (NTS) in the XTEN portion of the gene encoding the fusion protein. In one embodiment of the foregoing, the N-terminal XTEN sequence of the expressed GPXTEN has at least 90% sequence identity to the sequence of AE48 or AM48, AE624, or AE912 or AM923. In another embodiment of the foregoing, the XTEN has the N-terminal residues described in Examples 14-17.

In other cases, the GPXTEN fusion protein can comprise a first and a second XTEN sequence, wherein the cumulative total of the residues in the XTEN sequences is greater than about 400 to about 3000 amino acid residues. In embodiments of the foregoing, the GPXTEN fusion protein can comprise a first and a second XTEN sequence wherein the sequences each exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to at least a first or additionally a second XTEN selected from Table 5.

As described more fully below, the invention provides methods in which the GPXTEN is designed by selecting the length of the XTEN to confer a target half-life on a fusion protein administered to a subject. In general, XTEN lengths longer that about cumulative 400 residues incorporated into the GPXTEN compositions result in longer half-life compared to shorter cumulative lengths; e.g., shorter than about 280 residues. However, in another embodiment, GPXTEN fusion proteins can be designed to comprise XTEN with a longer sequence length that is selected to additionally confer slower rates of systemic absorption after subcutaneous or intramuscular administration to a subject. In such cases, the $C_{max}$ is reduced in comparison to a comparable dose of a GP not linked to XTEN, thereby contributing to the ability to keep the GPXTEN within the therapeutic window for the composition. Thus, the XTEN confers the property of a depot to the administered GPXTEN, in addition to the other physical/chemical properties described herein.

TABLE 5

XTEN Polypeptides

| XTEN Name | Amino Acid Sequence | SEQ ID NO: |
|---|---|---|
| AE48 | MAEPAGSPTSTEEGTPGSGTASSSPGSSTPSGATGSPGASPGTSSTGS | 187 |
| AM48 | MAEPAGSPTSTEEGASPGTSSTGSPGSSTPSGATGSPGSSTPSGATGS | 188 |
| AE144 | GSEPATSGSETPGTSESATPESGPGSEPATSGSETPGSPAGSPTSTEEGTSTEPSEGSAPGSEPAT SGSETPGSEPATSGSETPGSEPATSGSETPGTSTEPSEGSAPGTSESATPESGPGSEPATSGSETP GTSTEPSEGSAP | 189 |
| AF144 | GTSTPESGSASPGTSPSGESSTAPGTSPSGESSTAPGSTSSTAESPGPGSTSESPSGTAPGSTSST AESPGPGTSPSGESSTAPGTSTPESGSASPGSTSSTAESPGPGTSPSGESSTAPGTSPSGESSTAP GTSPSGESSTAP | 190 |
| AE288 | GTSESATPESGPGSEPATSGSETPGTSESATPESGPGSEPATSGSETPGTSESATPESGPGTSTEP SEGSAPGSPAGSPTSTEEGTSESATPESGPGSEPATSGSETPGTSESATPESGPGSPAGSPTSTEE GSPAGSPTSTEEGTSTEPSEGSAPGTSESATPESGPGTSESATPESGPGTSESATPESGPGSEPAT SGSETPGSEPATSGSETPGSPAGSPTSTEEGTSTEPSEGSAPGTSTEPSEGSAPGSEPATSGSETP GTSESATPESGPGTSTEPSEGSAP | 191 |
| AF504 | GASPGTSSTGSPGSSPSASTGTGPGSSPSASTGTGPGTPGSGTASSSPGSSTPSGATGSPGSXPSA STGTGPGASPGTSSTGSPGTPGSGTASSSPGSSTPSGATGSPGASPGTSSTGSPGTPGSGTASSSPGSSTPS GASPGTSSTGSPGTPGSGTASSSPGSSTPSGATGSPGASPGTSSTGSPGTPGSGTASSSPGSSTPS GATGSPGSXPSASTGTGPGSSPSASTGTGPGSSTPSGATGSPGSSTPSGATGSPGASPGTSSTGSP GASPGTSSTGSPGASPGTSSTGSPGTPGSGTASSSPGASPGTSSTGSPGASPGTSSTGSPGASPGT SSTGSPGSSPSASTGTGPGTPGSGTASSSPGASPGTSSTGSPGASPGTSSTGSPGASPGTSSTGSP GSSTPSGATGSPGSSTPSGATGSPGASPGTSSTGSPGTPGSGTASSSPGSSTPSGATGSPGSSTPS GATGSPGSSTPSGATGSPGSSPSASTGTGPGASPGTSSTGSP | 192 |
| AF540 | GSTSSTAESPGPGSTSSTAESPGPGSTSESPSGTAPGSTSSTAESPGPGSTSSTAESPGPGTSTPE SGSASPGSTSESPSGTAPGTSPSGESSTAPGSTSESPSGTAPGSTSESPSGTAPGTSPSGESSTAP GSTSESPSGTAPGSTSESPSGTAPGTSPSGESSTAPGSTSESPSGTAPGSTSESPSGTAPGSTSES PSGTAPGTSTPESGSASPGSTSESPSGTAPGTSTPESGSASPGSTSSTAESPGPGSTSSTAESPGP GTSTPESGSASPGTSTPESGSASPGSTSESPSGTAPGTSTPESGSASPGTSTPESGSASPGSTSES PSGTAPGSTSESPSGTAPGSTSESPSGTAPGSTSSTAESPGPGTSTPESGSASPGTSTPESGSASP GSTSESPSGTAPGSTSESPSGTAPGTSTPESGSASPGSTSESPSGTAPGSTSESPSGTAPGTSTPE SGSASPGTSPSGESSTAPGSTSSTAESPGPGTSPSGESSTAPGSTSSTAESPGPGTSTPESGSASP GSTSESPSGTAP | 193 |
| AD576 | GSSESGSSEGGPGSGGEPSESGSSGSSESGSSEGGPGSSESGSSEGGPGSSESG SSEGGPGSSESGSSEGGPGESPGGSSGSSESGSEGSSGPGESSGSSESGSSEGGP GSSESGSSEGGPGSGGEPSESGSSGESPGGSSGSESGSESPGGSSGSESGSGGEPSESGSSGSSESG SSEGGPGSGGEPSESGSGSGGEPSESGSSGSESGSSGPGESSGESPGGSSGSESGSGGEPSESGSS GSGGEPSESGSSGSGGEPSESGSSGSSESGSSEGGPGESPGGSSGSESGESPGGSSGSESGESPGG SSGSESGESPGGSSGSESGSSESGSSEGGPGSGGEPSESGSSGSEGSSGPGESS GSSESGSSEGGPGSGGEPSESGSSGSSESGSSEGGPGSGGEPSESGSSGESPGGSSGSESGESPGG SSGSESGSSESGSEGGPGSGGEPSESGSSGSSESGSSEGGPGSGGEPSESGSSGSGGEPSESGSS GESPGGSSGSESGSEGSSGPGESSGSSESGSSEGGPGSEGSSGPGESS | 194 |
| AE576 | GSPAGSPTSTEEGTSESATPESGPGTSTEPSEGSAPGSPAGSPTSTEEGTSTEPSEGSAPGTSTEP SEGSAPGTSESATPESGPGSEPATSGSETPGSEPATSGSETPGSPAGSPTSTEEGTSESATPESGP GTSTEPSEGSAPGTSTEPSEGSAPGSPAGSPTSTEEGTSTEPSEGSAPGTSTEPSEGSAPGTSESA TPESGPGTSTEPSEGSAPGTSESATPESGPGSEPATSGSETPGSTEPSEGSAPGTSTEPSEGSAPG TSESATPESGPGTSESATPESGPGSPAGSPTSTEEGTSESATPESGPGSEPATSGSETPGTSESAT PESGPGTSTEPSEGSAPGTSTEPSEGSAPGTSTEPSEGSAPGTSTEPSEGSAPG TSTEPSEGSAPGSPAGSPTSTEEGTSTEPSEGSAPGTSESATPESGPGSEPATSGSETPGTSESAT PESGPGSEPATSGSETPUSESATPESGPQSTEPSEGSAPGTSESATP | 195 |
| AF576 | ESGPGSPAGSPTSTEEGSPAGSPTSTEEGSPAGSPTSTEEGTSESATPESGPGTSTEPSEGSAPGS TSSTAESPGPGSTSSTAESPGPGSTSESPSGTAPGSTSSTAESPGPGSTSSTAESPGPGTSTPESG SASPGSTSESPSGTAPGTSPSGESSTAPGSTSESPSGTAPGSTSESPSGTAPGTSPSGESSTAPGS TSESPSGTAPGSTSESPSGTAPGTSPSGESSTAPGSTSESPSGTAPGSTSESPSGTAPGSTSESPS GTAPGTSTPESGSASPGSTSESPSGTAPGTSTPESGSASPGSTSSTAESPGPGSTSSTAESPGPGT STPESGSASPGTSTPESGSASPGSTSESPSGTAPGTSTPESGSASPGTSTPESGSASPGSTSESPS GTAPGSTSESPSGTAPGSTSESPSGTAPGSTSSTAESPGPGTSTPESGSASPGTSTPESGSASPGS TSESPSGTAPGSTSESPSGTAPGTSTPESGSASPGSTSESPSGTAPGSTSESPSGTAPGTSTPESG SASPGTSPSGESSTAPGSTSSTAESPGPGTSPSGESSTAPGSTSSTAESPGPGTSTPESGSASPGS TSESPSGTAPGSTSSTAESPGPGTSTPESGSASPGTSTPESGSASP | 196 |

TABLE 5-continued

XTEN Polypeptides

| XTEN Name | Amino Acid Sequence | SEQ ID NO: |
|---|---|---|
| AE624 | MAEPAGSPTSTEEGTPGSGTASSSPGSS1TSGATGSPGASPGTSSTGSPGSPAGSPTSTEEGTSES<br>ATPESGPGTSTEPSEGSAPGSPAGSPTSTEEGTSTEPSEGSAPGTSTEPSEGSAPQSESATPESGP<br>GSEPATSGSETPGSEPATSGSETPGSPAGSPTSTEEGTSESATPESGPGTSTEPSEGSAPGTSTEP<br>SEGSAPGSPAGSPTSTEEGTSTEPSEGSAPGTSTEPSEGSAPGTSESATPESGPGTSTEPSEGSAP<br>GTSESATPESGPGSEPATSGSETPGTSTEPSEGSAPGTSTEPSEGSAPGSESATPESGPGTSESAT<br>PESGPGSPAGSPTSTEEGTSESATPESGPGSEPATSGSETPGTSESATPESGPGTSTEPSEGSAPG<br>TSTEPSEGSAPGTSTEPSEGSAPGTSTEPSEGSAPGTSTEPSEGSAPGTSTEPSEGSAPGSPAGSP<br>TSTEEGTSTEPSEGSAPGTSESATPESGPGSEPATSGSETPGTSESATPESGPGSEPATSGSETPG<br>TSESATPESGPGTSTEPSEGSAPGTSESATPESGPGSPAGSPTSTEEGSPAGSPTSTEEGSPAGSP<br>TSTEEGTSESATPESGPGTSTEPSEGSAP | 197 |
| AD836 | GSSESGSSEGGPGSSESGSSEGGPGSSESGSSEGGPGESPGGSSGSESGSGGEPSESGSSGESPGG<br>SSGSESGSSESGSSEGGPGSSESGSSEGGPGSSESGSSEGGPGESPGGSSGSESGESPGGSSGSES<br>GESPGGSSGSESGSSESGSSEGGPGSSESGSSEGGPGSSESGSSEGGPGSSESGSSEGGPGSSESG<br>SSEGGPGSSESGSSEGGPGSGGEPSESGSSGESPGGSSGSESGESPGGSSGSESGSGGEPSESGSS<br>GESGSSGPGESSGSSESGSSEGGPGSGGEPSESGSSGESGSSGPGESSGSSESGSSEGGPGSSGEP<br>SESGSSGESPGGSSGSESGSGGEPSESGSSGSGGEPSESGSSGSESGSSEGGPGSGGEPSESGSS<br>GSGGEPSESGSSGSEGSSGPGESSGESPGGSSGSESGSEGSSGPGESSGSEGSSGPGESSGSGGEP<br>SESGSSGSSESGSSEGGPGSSESGSSEGGPGESPGGSSGSESGSGGEPSESGSGSEGSSGPGESS<br>GESPGGSSGSESGSESGSSGPGSSESGSSEGGPGSGGEPSESGSSGPGESSGESGSSGSSGSSGGE<br>SSGSEGSSGPGESSGSGGEPSESGSSGGGEPSESGSSGESPGGSSGESGESPGGSSGSESGSGG<br>EPSESGSSGSEGSSGPGESSGESPGGSSGSESGSSESGSSEGGPGSSESGSSEGGPGSSESGSSEG<br>GPGSGGEPSESGSSGSSESGSSEGGPGESPGGSSGSESGSGGEPSESGSSGSSESGSSEGGPGESP<br>GGSSGSESGSGGEPSESGSSGESPGGSSGSESGSGGEPSESGSS | 198 |
| AE864 | GSPAGSPTSTEEGTSESATPESGPGTSTEPSEGSAPGSPAGSPTSTEEGTSTEPSEGSAPGTSTEP<br>SEGSAPGTSESATPESGPGSEPATSGSETPGSEPATSGSETPGSPAGSPTSTEEGTSESATPESGP<br>GTSTEPSEGSAPGTSTEPSEGSAPGSPAGSPTSTEEGTSTEPSEGSAPGTSTEPSEGSAPGTSESA<br>TPESGPGTSTEPSEGSAPGTSESATPESGPGSEPATSGSETPGTSTEPSEGSAPGTSTEPSEGSAP<br>GTSESATPESGPGTSESATPESGPGSPAGSPTSTEEGTSESATPESGPGSEPATSGSETPGTSESA<br>TPESGPGTSTEPSEGSAPGTSTEPSEGSAPGTSTEPSEGSAPGTSTEPSEGSAPGTSTEPSEGSAP<br>GTSTEPSEGSAPGSPAGSPTSTEEGTSTEPSEGSAPGTSESATPESGPGSEPATSGSETPGTSESA<br>TPESGPGSEPATSGSETPGTSESATPESGPGTSTEPSEGSAPGTSESATPESGPGSPAGSPTSTEE<br>GSPAGSPTSTEEGSPAGSPTSTEEGTSESATPESGPGTSTEPSEGSAPGTSESATPESGPGSEPAT<br>SGSETPGTSESATPESGPGSEPATSGSETPGTSESATPESGPGTSTEPSEGSAPGSPAGSPTSTEE<br>GTSESATPESGPGSEPATSGSETPGTSESATPESGPGSPAGSPTSTEEGSPAGSPTSTEEGTSTEP<br>SEGSAPGTSESATPESGPGTSESATPESGPGTSESATPESGPGSEPATSGSETPGSEPATSGSETP<br>GSPAGSPTSTEEGTSTEPSEGSAPGTSTEPSEGSAPGSEPATSGSETPGTSESATPESGPGTSTEP<br>SEGSAP | 199 |
| AF864 | GSTSESPSGTAPGTSPSGESSTAPGSTSESPSGTAPGSTSESPSGTAPGTSTPESGSASPGTSTPE<br>SGSASPGSTSESPSGTAPGSTSESPSGTAPGTSPSGESSTAPGSTSESPSGTAPGTSPSGESSTAP<br>GTSPSGESSTAPGSTSSTAESPGPGTSPSGESSTAPGTSPSGESSTAPGSTSSTAESPGPGTSTPE<br>SGSASPGTSTPESGSASPGSTSESPSGTAPGSTSESPSGTAPGTSTPESGSASPGTSSTAESPGP<br>GTSTPESGSASPGSTSESPSGTAPGTSPSGESSTAPGSTSSTAESPGPGTSPSGESSTAPGTSTPE<br>SGSASPGSTSSTAESPGPGSTSSTAESPGPGSTSSTAESPGPGTSPSGESSTAP<br>GSTSESPSGTAPGSTSESPSGTAPGTSTPESGPXXXGASASGAPSTXXXXSESPSGTAPGSTSESP<br>SGTAPGSTSESPSGTAPGSTSESPSGTAPGSTSESPSGTAPGTSESPSGTAPGTSTPESGSASPG<br>TSPSGESSTAPGTSPSGESSTAPGSTSSTAESPGPGTSPSGESSTAPGSTSTPESGSASPGSTSESP<br>SGTAPGSTSESPSGTAPGTSPSGESSTAPGSTSESPSGTAPGTSTPESGSASPGTSTPESGSASPG<br>STSESPSGTAPGTSTPESGSASPGSTSSTAESPGPGTSESPSGTAPGSTSESPSGTAPGTSPSGE<br>SSTAPGSTSSTAESPGPGTSPSGESSTAPGTSTPESGSASPGTSPSGESSTAPGTSPSGESSTAPG<br>TSPSGESSTAPGSTSSTAESPGPGTSSTAESPGPGTSPSGESSTAPGSSPSASTGTGPGSSTPSG<br>ATGSPGSSTPSGATGSP | 200 |
| AG864 | GASPGTSSTGSPGSSPSASTGTGPGSSPSASTGTGPGTPGSGTASSSPGSSTPSGATGSPGSSPSA<br>STGTGPGASPGTSSTGSPGTPGSGTASSSPGSSTPSGATGSPGTPGSGTASSSPGASPGTSSTGSP<br>GASPGTSSTGSPGTPGSGTASSSPGSSTPSGATGSPGASPGSSTPSGTPGSGTASSSPGSSTPS<br>GATGSPGSSPSASTGTGPGSSPSASTGTGPGSSTPSGATGSPGSSTPSGATGSPGASPGTSSTGSP<br>GASPGTSSTGSPGASPGTSSTGSPGTPGSGTASSSPGASPGTSSTGSPGASPGTSSTGSPGASPGT<br>SSTGSPGSSPSASTGTGPGTPGSGTASSSPGASPGTSSTGSPGASPGTSSTGSPGASPGTSSTGSP<br>GSSTPSGATGSPGSSTPSGATGSPGASPGTSSTGSPGTPGSGTASSSPGASPGTSSTGSPGASPGT<br>SSTGSPGASPGTSSTGSPGASPGTSSTGSPGASPGTSSTGSPGTPGSGTASSSPGSSTPS<br>GATGSPGTPGSGTASSSPGSSTPSGATGSPGTPGSGTASSSPGSSTPSGATGSPGSSTPSGATGSP<br>GSSPSASTGTGPGSSPSASTGTGPGASPGTSSTGSPGTPGSGTASSSPGSSTPSGATGSPGSSPSA<br>STGTGPGSSPSASTGTGPGASPGTSSTGSPGASPGTSSTGSPGSSTPSGATGSPGSSPSASTGTGP<br>GASPGTSSTGSPGSSPSASTGTGPGTPGSGTASSSPGSSTPSGATGSPGSSTPSGATGSPGASPGT<br>SSTGSP | 201 |
| AM875 | GTSTEPSEGSAPGSEPATSGSETPGSPAGSPTSTEEGTSSSTAESPGPGTSTPESGSASPGTSES<br>PSGTAPGSTSESPSGTAPGTSTPESGSASPGTSTPESGSASPGSEPATSGSETPGTSESATPESGP<br>GSPAGSPTSTEEGTSTEPSEGSAPGTSESATPESGPGTSTEPSEGSAPGTSTEPSEGSAPGSPAGS<br>PTSTEEGTSTEPSEGSAPGTSTEPSEGSAPGTSESATPESGPGTSESATPESGPGTSTEPSEGSAP<br>GTSTEPSEGSAPGTSESATPESGPGTSTEPSEGSAPGSEPATSGSETPGSPAGSPTSTEEGSSTPS | 202 |

TABLE 5-continued

XTEN Polypeptides

| XTEN Name | Amino Acid Sequence | SEQ ID NO: |
|---|---|---|
| | GATGSPGTPGSGTASSSPGSSTPSGATGSPGTSTEPSEGSAPGTSTEPSEGSAPGSEPATSGSETP<br>GSPAGSPTSTEEGSPAGSPTSTEEGTSTEPSEGSAPGASASGAPSTGGTSESATPESGPGSPAGSP<br>TSTEEGSPAGSPTSTEEGSTSSTAESPGPGSTSESPSGTAPGTSPSGESSTAPGTGPGSTASSSPG<br>SSTPSGATGSPGSSPSASTGTGPGSEPATSGSETPGTSESATPESGPGSEPATSGSETPGSTSSTA<br>ESPGPGSTSSTAESPGPGTSPSGESSTAPGSEPATSGSETPGSEPATSGSETPGTSTEPSEGSAPG<br>STSSTAESPGPGTSTPESGSASPGSTSESPSGTAPGTSTEPSEGSAPGTSTEPSEGSAPGTSTEPS<br>EGSAPGSSTPSGATGSPGSSPSASTGTGPGASPGTSSTGSPGSEPATSGSETPGTSESATPESGPG<br>GSPAGSPTSTEEGSSTPSGATGSPGSSPSASTGTGPGASPGTSSTSPGTSESATPESGPGTSTEPS<br>EGSAPGTSTEPSEGSAP | |
| AE912 | MAEPAGSPTSTEEGTPGSGTASSSPGSSTPSGATGSPGASPGTSSTGSPGSPAGSPTSTEEGTSES<br>ATPESGPGTSTEPSEGSAPGSPAGSPTSTEEGTSTEPSEGSAPGTSESATPESG<br>PGSEPATSGSETPGSEPATSGSETPGSPAGSPTSTEEGTSESATPESGPGTSTEPSEGSAPGTSTE<br>PSEGSAPGSPAGSPTSTEEGTSTEPSEGSAPGTSTEPSEGSAPGTSESATPESGPGTSTEPSEGSA<br>PGTSESATPESGPGSEPATSGSETPGTSTEPSEGSAPGTSTEPSEGSAPGTSESATPESGPGTSES<br>ATPESGPGSPAGSPTSTEEGTSESATPESGPGSEPATSGSETPGTSTEPSEGSA<br>PGTSTEPSEGSAPGTSTEPSEGSAPGTSTEPSEGSAPGTSTEPSEGSAPGTSTEPSEGSAPGSPAG<br>SPTSTEEGTSTEPSEGSAPGTSESATPESGPGSEPATSGSETPGTSESATPESGPGSEPATSGSET<br>PGTSESATPESGPGTSTEPSEGSAPGTSESATPESGPGSPAGSPTSTEEGSPAGSPTSTEEGSPAG<br>SPTSTEEGTSESATPESGPGTSTEPSEGSAPGTSESATPESGPGSEPATSGSETPGTSESATPESG<br>PGSEPATSGSETPGTSESATPESGPGTSTEPSEGSAPGSPAGSPTSTEEGTSESATPESGPGSEPA<br>TSGSETPGTSESATPESGPGSPAGSPTSTEEGSPAGSPTSTEEGTSTEPSEGSAPGTSESATPESG<br>PGTSESATPESGPGTSESATPESGPGSEPATSGSETPGSEPATSGSETPGSPAGSPTSTEEGTSTE<br>PSEGSAPGSEPATSGSETPGTSESATPESGPGTSTEPSEGSAP | 203 |
| Am923 | MAEPAGSPTSTEEGASPGTSSTGSPGSSTPSGATGSPGSSTPSGATGSPGTSTEPSEGSAPGSEPA<br>TSGSETPGSPAGSPTSTEEGSTSSTAESPGPGTSTPESGSASPGSTSESPSGTAPGSTSESPSGTA<br>PGTSTPESGSASPGTSTPESGSASPGSEPATSGSETPGTSESATPESGPGSPAGSPTSTEEGTSTE<br>PSEGSAPGTSESATPESGPGTSTEPSEGSAPGTSTEPSEGSAPGSPAGSPTSTEEGTSTEPSEGSA<br>PGTSTEPSEGSAPGTSESATPESGPGTSESATPESGPGTSTEPSEGSAPGTSTEPSEGSAPGTSES<br>ATPESGPGTSTEPSEGSAPGSEPATSGSETPGSPAGSPTSTEEGSSTPSGATGSPGTPGSGTASSS<br>PGSSTPSGATGSPGTSTEPSEGSAPGTSTEPSEGSAPGSEPATSGSETPGSPAGSPTSTEEGSPAG<br>SPTSTEEGTSTEPSEGSAPGASASGAPSTGGTSESATPESGPGSPAGSPTSTEEGSPAGSPTSTEE<br>GSTSSTAESPGPGSTSESPSGTAPGTSPSGESSTAPGTPGSGTASSSPGSSTPSGATGSPGSSPSA<br>STGTGPGSEPATSGSETPGTSESATPESGPGSEPATSGSETPGTSSTAESPGPGSTSSTAESPGP<br>GTSPSGESSTAPGSEPATSGSETPGSEPATSGSETPGTSTEPSEGSAPGSTSSTAESPGPGTSTPE<br>SGSASPGSTSESPSGTAPGTSTEPSEGSAPGTSTEPSEGSAPGSTSSTAESPGPGSSTPSGATGSP<br>GSSPSASTGTGPGASPGTSSTGSPGSEPATSGSETPGTSESATPESGPGSPAGSPTSTEEGSSTPS<br>GATGSPGSSPSASTGTGPGASPGTSSTGSPGTSESATPESGPGTSTEPSEGSAPGTSTEPSEGSAP | 204 |
| AM1318 | GTSTEPSEGSAPGSEPATSGSETPGSPAGSPTSTEEGSTSSTAESPGPGTSTPESGSASPGSTSES<br>PSGTAPGSTSESPSGTAPGTSTPESGSASPGTSTPESGSASPGSEPATSGSETPGTSESATPESGP<br>GSPAGSPTSTEEGTSTEPSEGSAPGTSESATPESGPGTSTEPSEGSAPGTSTEPSEGSAPGSPAGS<br>PTSTEEGTSTEPSEGSAPGTSTEPSEGSAPGTSESATPESGPGTSESATPESGPGTSTEPSEGSAP<br>GTSTEPSEGSAPGTSESATPESGPGTSTEPSEGSAPGSEPATSGSETPGSPAGSPTSTEEGSSTPS<br>GATGSPGTPGSGTASSSPGSSTPSGATGSPGTSTEPSEGSAPGTSTEPSEGSAPGSEPATSGSETP<br>GSPAGSPTSTEEGSPAGSPTSTEEGTSTEPSEGSAPGPEPTGPAPSGGSEPATSGSETPGTSESAT<br>PESGPGSPAGSPTSTEEGTSESATPESGPGSPAGSPTSTEEGSPAGSPTSTEEGTSESATPESGPG<br>SPAGSPTSTEEGSPAGSPTSTEEGSTSSTAESPGPGTSESPSGTAPGSPSGESSTAPGTSESP<br>SGTAPGSTSESPSGTAPGTSPSGESSTAPGTSTEPSEGSAPGTSESATPESGPGTSESATPESGPG<br>SEPATSGSETPGTSESATPESGPGTSESATPESGPGTSTEPSEGSAPGTSESATPESGPGTSTEPS<br>EGSAPGTSPSGESSTAPGTSPSGESSTAPGTSPSGESSTAPGTSTEPSEGSAPGSPAGSPTSTEEG<br>TSTEPSEGSAPGSSPSASTGTGPGSSTPSGATGSPGSSTPSGATGSPGSSTPSGATGSPGSSTPSG<br>ATGSPGASPGTSSTGSPGASASGAPSTGGTSPSGESSTAPGSTSSTAESPGPGTSPSGESSTAPGT<br>SESATPESGPGTSTEPSEGSAPGTSTEPSEGSAPGSSPSASTGTGPGSSTPSGATGSPGASPGTSS<br>TGSPGTSTPESGSASPGTSPSGESSTAPGTSPSGESSTAPGTSESATPESGPGSEPATSGSETPGT<br>STEPSEGSAPGSTSESPSGTAPGSTSESPSGTAPGTSTPESGSASPGSPAGSPTSTEEGTSESATP<br>ESGPGTSTEPSEGSAPGSPAGSPTSTEEGTSESATPESGPGSSTPSGATGSPGA<br>SPGTSSTGSPGSSTPSGATGSPGTSESPSGTAPGTSPSGESSTAPGSTSSTAESPGPGSSTPSGA<br>TGSPGASPGTSSTGSPGTPGSGTASSSPGSPAGSPTSTEEGSPAGSPTSTEEGTSTEPSEGSAP | 205 |
| BC864 | GTSTEPSEPGSAGTSTEPSEPGSAGSEPATSGTEPSGSGASEPTSTEPGSEPATSGTEPSGSEPAT<br>SGTEPSGSEPATSGTEPSGSGASEPTSTEPGTSTEPSEPGSAGSEPATSGTEPSGTSTEPSEPGSA<br>GSEPATSGTEPSGSEPATSGTEPSGTSTEPSEPGSAGTSTEPSEPGSAGSEPATSGTEPSGSEPAT<br>SGTEPSGTSEPSTSEPGAGSGASEPTSTEPGTSEPSTSEPGAGSEPATSGTEPSGSEPATSGTEPS<br>GTSTEPSEPGSAGTSTEPSEPGSAGSGASEPTSTEPGSEPATSGTEPSGSEPATSGTEPSGSEPAT<br>SGTEPSGSEPATSGTEPSGTSTEPSEPGSAGSEPATSGTEPSGSGASEPTSTEPGTSTEPSEPGSA<br>GSEPATSGTEPSGSGASEPTSTEPGTSTEPSEPGSAGSGASEPTSTEPGSEPATSGTEPSGSGASE<br>PTSTEPGSEPATSGTEPSGSGASEPTSTEPGTSTEPSEPGSAGSEPATSGTEPSGSGASEPTSTEP<br>GTSTEPSEPGSAGSEPATSGTEPSGTSTEPSEPGSAGSEPATSGTEPSGTSTEPSEPGSAGTSTEP<br>SEPGSAGTSTEPSEPGSAGTSTEPSEPGSAGTSTEPSEPGSAGTSTEPSEPGSAGTSEPSTSEPGA<br>GSGASEPTSTEPGTSTEPSEPGSAGTSTEPSEPGSAGTSTEPSEPGSAGSEPATSGTEPSGSGASE<br>PTSTEPGSEPATSGTEPSGSEPATSGTEPSGSEPATSGTEPSGSEPATSGTEPSGTSEPSTSEPGA<br>GSEPATSGTEPSGSGASEPTSTEPGTSTEPSEPGSAGSEPATSGTEPSGSGASEPTSTEPGTSTEP<br>SEPGSA | 206 |

TABLE 5-continued

XTEN Polypeptides

| XTEN Name | Amino Acid Sequence | SEQ ID NO: |
|---|---|---|
| BD864 | GSETATSGSETAGTSESATSESGAGSTAGSETSTEAGTSESATSESGAGSETATSGSETAGSETAT SGSETAGTSTEASEGSASGTSTEASEGSASGTSESATSESGAGSETATSGSETAGTSTEASEGSAS GSTAGSETSTEAGTSESATSESGAGTSESATSESGAGSETATSGSETAGTSESATSESGAGTSTEA SEGSASGSETATSGSETAGSETATSGSETAGTSTEASEGSASGSTAGSETSTEAGTSESATSESGA GTSTEASEGSASGSETATSGSETAGSTAGSETSTEAGSTAGSETSTEAGSETATSGSETAGTSESA TSESGAGTSESATSESGAGSETATSGSETAGTSESATSESGAGTSESATSESGAGSETATSGSETA GSETATSGSETAGTSTEASEGSASGSTAGSETSTEAGSETATSGSETAGTSESATSESGAGSTAGS ETSTEAGSTAGSETSTEAGSTAGSETSTEAGTSTEASEGSASGSTAGSETSTEAGSTAGSETSTEA GTSTEASEGSASGSTAGSETSTEAGSETATSGSETAGTSTEASEGSASGTSESATSESGAGSETAT SGSETAGTSESATSESGAGTSESATSESGAGSETATSGSETAGTSESATSESGAGSETATSGSETA GTSTEASEGSASGTSTEASEGSASGSTAGSETSTEAGSTAGSETSTEAGSETATSGSETAGTSESA TSESGAGTSESATSESGAGSETATSGSETAGSETATSGSETAGSETATSGSETAGTSTEASEGSAS GTSESATSESGAGSETATSGSETAGSETATSGSETAGTSESATSESGAGTSESATSESGAGSETAT SGSETA | 207 |

4. XTEN Segments

In one embodiment, the invention provides an isolated GPXTEN fusion protein wherein the cumulative length of the XTEN component is greater than about 100 to about 3000 amino acid residues containing at least one polypeptide sequence segment selected from Tables 5, 10, 11, 12, and 13 and wherein at least about 90%, or at least about 91%, or at least about 92%, or at least about 93%, or at least about 94%, or at least about 95%, or at least about 96%, or at least about 97%, or at least about 98% or more of the remainder of the XTEN sequence consists of hydrophilic amino acids and less than about 2% of the remainder of the XTEN by and large contains hydrophobic, aromatic or cysteine amino acids. In the foregoing embodiment, the XTEN can contain multiple segments wherein the segments are identical or different. In another embodiment, the invention provides an isolated GPXTEN fusion protein wherein the cumulative length of the XTEN component is greater than about 100 to about 3000 amino acid residues and comprises at least one sequence segment of at least about 100 to about 923, or at least about 100 to about 875, or at least about 100 to about 576, or at least about 100 to about 288, or at least about 100 to about 144 amino acid residues wherein the sequence segment(s) consists of at least three different types of amino acids and the sum of glycine (G), alanine (A), serine (S), threonine (T), glutamate (E) and proline (P) residues in the sequence segment(s) constitutes at least about 90%, or at least about 91%, or at least about 92%, or at least about 93%, or at least about 94%, or at least about 95%, or at least about 96%, or at least about 97%, or at least about 98%, or at least about 99% of the total amino acid sequence of the sequence segment and at least about 90%, or at least about 91%, or at least about 92%, or at least about 93%, or at least about 94%, or at least about 95%, or at least about 96%, or at least about 97%, or at least about 98% of the remainder of the XTEN sequence(s) consist of hydrophilic amino acids and less than about 2% of the remainder of the XTEN sequence(s) consists of hydrophobic, aromatic or cysteine amino acids. In another embodiment, the invention provides an isolated GPXTEN fusion protein wherein the cumulative length of the XTEN component is greater than about 100 to about 3000 amino acid residues and comprises at least one sequence segment of at least about 200 to about 923, or at least about 200 to about 875, or at least about 200 to about 576, or at least about 200 to about 288 amino acid residues wherein the sequence segment(s) the sum of glycine (G), alanine (A), serine (S), threonine (T), glutamate (E) and proline (P) residues in the sequence segment(s) constitutes at least about 90%, or at least about 91%, or at least about 92%, or at least about 93%, or at least about 94%, or at least about 95%, or at least about 96%, or at least about 97%, or at least about 98%, or at least about 99% of the total amino acid sequence of the sequence segment and wherein the subsequence score of the segment is less than 12, more preferably less than 10, more preferably less than 9, more preferably less than 8, more preferably less than 7, more preferably less than 6, and most preferably less than 5, and at least about 90%, or at least about 91%, or at least about 92%, or at least about 93%, or at least about 94%, or at least about 95%, or at least about 96%, or at least about 97%, or at least about 98% of the remainder of the XTEN sequence(s) consist of hydrophilic amino acids and less than about 2% of the remainder of the XTEN sequence(s) consists of hydrophobic, aromatic or cysteine amino acids.

5. N-Terminal XTEN Expression-Enhancing Sequences

In some embodiments, the invention provides a short-length XTEN sequence as the N-terminal portion of the GPXTEN fusion protein. The expression of the fusion protein is enhanced in a host cell transformed with a suitable expression vector comprising an optimized N-terminal leader polynucleotide sequence (that encodes the N-terminal XTEN) incorporated into the polynucleotide encoding the binding fusion protein. It has been discovered, as described in Examples 14-17, that a host cell transformed with such an expression vector comprising an optimized N-terminal leader sequence (NTS) in the binding fusion protein gene results in greatly-enhanced expression of the fusion protein compared to the expression of a corresponding fusion protein from a polynucleotide not comprising the NTS, and can obviate the need for incorporation of a non-XTEN leader sequence used to enhance expression. In one embodiment, the invention provides GPXTEN fusion proteins comprising an NTS wherein the expression of the binding fusion protein from the encoding gene in a host cell is enhanced about 50%, or about 75%, or about 100%, or about 150%, or about 200%, or about 400% compared to expression of a GPXTEN fusion protein not comprising the N-terminal XTEN sequence (where the encoding gene lacks the NTS).

In one embodiment, the N-terminal XTEN polypeptide of the GPXTEN comprises a sequence that exhibits at least about 80%, or at least about 90%, or at least about 91%, or at least about 92%, or at least about 93%, or at least about 94%, or at least about 95%, or at least about 96%, or at least about 97%, or at least about 98%, or at least 99%, or exhibits 100% sequence identity to the amino acid sequence of AE48 or AM48, the respective sequences of which are as follows:

AE48:
(SEQ ID NO: 208)
MAEPAGSPTSTEEGTPGSGTASSSPGSSTPSGATGSPGASPGTSSTGS

AM48:
(SEQ ID NO: 209)
MAEPAGSPTSTEEGASPGTSSTGSPGSSTPSGATGSPGSSTPSGATGS

In another embodiment, the short-length N-terminal XTEN can be linked to an XTEN of longer length to form the N-terminal region of the GPXTEN fusion protein, wherein the polynucleotide sequence encoding the short-length N-terminal XTEN confers the property of enhanced expression in the host cell, and wherein the long length of the expressed XTEN contributes to the enhanced properties of the XTEN carrier in the fusion protein, as described above. In the foregoing, the short-length XTEN can be linked to any of the XTEN disclosed herein (e.g., an XTEN of Table 5) and the resulting XTEN, in turn, is linked to the N-terminal of any of the GP disclosed herein (e.g., a GP of Tables 1-3) as a component of the fusion protein. Alternatively, polynucleotides encoding the short-length XTEN (or its complement) is linked to polynucleotides encoding any of the XTEN (or its complement) disclosed herein and the resulting gene encoding the N-terminal XTEN, in turn, is linked to the 5' end of polynucleotides encoding any of the GP (or to the 3' end of its complement) disclosed herein. In some embodiments, the N-terminal XTEN polypeptide with long length exhibits at least about 80%, or at least about 90%, or at least about 91%, or at least about 92%, or at least about 93%, or at least about 94%, or at least about 95%, or at least about 96%, or at least about 97%, or at least about 98%, or at least 99%, or exhibits 100% sequence identity to an amino acid sequence selected from the group consisting of the sequences AE624, AE912, and AM923.

In any of the foregoing N-terminal XTEN embodiments described above, the N-terminal XTEN can have from about one to about six additional amino acid residues, preferably selected from GESTPA, to accommodate the restriction endonuclease restriction sites that would be employed to join the nucleotides encoding the N-terminal XTEN to the gene encoding the targeting moiety of the fusion protein. The methods for the generation of the N-terminal sequences and incorporation into the fusion proteins of the invention are described more fully in the Examples.

6. Net Charge

In other embodiments, the XTEN polypeptides have an unstructured characteristic imparted by incorporation of amino acid residues with a net charge and/or reducing the proportion of hydrophobic amino acids in the XTEN sequence. The overall net charge and net charge density is controlled by modifying the content of charged amino acids in the XTEN sequences. In some embodiments, the net charge density of the XTEN of the compositions may be above +0.1 or below −0.1 charges/residue. In other embodiments, the net charge of a XTEN can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more.

Since most tissues and surfaces in a human or animal have a net negative charge, in some embodiments, the XTEN sequences are designed to have a net negative charge to minimize non-specific interactions between the XTEN containing compositions and various surfaces such as blood vessels, healthy tissues, or various receptors. Not to be bound by a particular theory, the XTEN can adopt open conformations due to electrostatic repulsion between individual amino acids of the XTEN polypeptide that individually carry a net negative charge and that are distributed across the sequence of the XTEN polypeptide. Such a distribution of net negative charge in the extended sequence lengths of XTEN can lead to an unstructured conformation that, in turn, can result in an effective increase in hydrodynamic radius. In preferred embodiments, the negative charge is conferred by incorporation of glutamic acid residues. Accordingly, in one embodiment the invention provides XTEN in which the XTEN sequences contain about 8, 10, 15, 20, 25, or even about 30% glutamic acid. Generally, the glutamic residues would be spaced uniformly across the XTEN sequence. In some cases, the XTEN can contain about 10-80, or about 15-60, or about 20-50 glutamic residues per 20 kD of XTEN that can result in an XTEN with charged residues that would have very similar pKa, which can increase the charge homogeneity of the product and sharpen its isoelectric point, enhancing the physicochemical properties of the resulting GPXTEN fusion protein for, example, simplifying purification procedures.

The XTEN of the compositions of the present invention generally have no or a low content of positively charged amino acids. In some embodiments the XTEN may have less than about 10% amino acid residues with a positive charge, or less than about 7%, or less than about 5%, or less than about 2%, or less than about 1% amino acid residues with a positive charge. However, the invention contemplates' constructs where a limited number of amino acids with a positive charge, such as lysine, are incorporated into XTEN to permit conjugation between the epsilon amine of the lysine and a reactive group on a peptide, a linker bridge, or a reactive group on a drug or small molecule to be conjugated to the XTEN backbone. In one embodiment of the foregoing, the XTEN has between about 1 to about 100 lysine residues, or about 1 to about 70 lysine residues, or about 1 to about 50 lysine residues, or about 1 to about 30 lysine residues, or about 1 to about 20 lysine residues, or about 1 to about 10 lysine residues, or about 1 to about 5 lysine residues, or alternatively only a single lysine residue. Using the foregoing lysine-containing XTEN, fusion proteins are constructed that comprises XTEN, a glucose regulating peptide, plus a chemotherapeutic agent useful in the treatment of glucose diseases or disorders, wherein the maximum number of molecules of the agent incorporated into the XTEN component is determined by the numbers of lysines or other amino acids with reactive side chains (e.g., cysteine) incorporated into the XTEN.

In some embodiments, the XTEN sequence comprises charged residues separated by other residues such as serine or glycine, which leads to better expression or purification behavior. Based on the net charge, some XTENs have an isoelectric point (pI) of 1.0, 1.5, 2.0, 2.5, 3.0, 3.5, 4.0, 4.5, 5.0, 5.5, 6.0, or even 6.5. In preferred embodiments, the XTEN will have an isoelectric point between 1.5 and 4.5. In these embodiments, the XTEN incorporated into the GPXTEN fusion protein compositions of the present invention carry a net negative charge under physiologic conditions that contribute to the unstructured conformation and reduced binding of the XTEN component to mammalian proteins and tissues.

As hydrophobic amino acids impart structure to a polypeptide, the invention provides that the content of hydrophobic amino acids in the XTEN will typically be less than 5%, or less than 2%, or less than 1% hydrophobic amino acid content. In one embodiment, the amino acid content of methionine and tryptophan in the XTEN component of a GPXTEN fusion protein is typically less than 5%, or less than 2%, and most preferably less than 1%. In another embodiment, the XTEN will have a sequence that has less than 10% amino acid residues with a positive charge, or less than about 7%, or less that about 5%, or less than about 2% amino acid residues with a positive charge, the sum of methionine and tryptophan residues will be less than 2%, and the sum of asparagine and glutamine residues will be less than 10% of the total XTEN sequence.

7. Low Immunogenicity

In another aspect, the invention provides compositions in which the XTEN sequences have a low degree of immunogenicity or are substantially non-immunogenic. Several factors can contribute to the low immunogenicity of XTEN, e.g., the non-repetitive sequence, the unstructured conformation, the high degree of solubility, the low degree or lack of self-aggregation, the low degree or lack of proteolytic sites within the sequence, and the low degree or lack of epitopes in the XTEN sequence.

Conformational epitopes are formed by regions of the protein surface that are composed of multiple discontinuous amino acid sequences of the protein antigen. The precise folding of the protein brings these sequences into a well-defined, stable spatial configurations, or epitopes, that can be recognized as "foreign" by the host humoral immune system, resulting in the production of antibodies to the protein or the activation of a cell-mediated immune response. In the latter case, the immune response to a protein in an individual is heavily influenced by T-cell epitope recognition that is a function of the peptide binding specificity of that individual's HLA-DR allotype. Engagement of a MHC Class II peptide complex by a cognate T-cell receptor on the surface of the T-cell, together with the cross-binding of certain other co-receptors such as the CD4 molecule, can induce an activated state within the T-cell. Activation leads to the release of cytokines further activating other lymphocytes such as B cells to produce antibodies or activating T killer cells as a full cellular immune response.

The ability of a peptide to bind a given MHC Class II molecule for presentation on the surface of an APC (antigen presenting cell) is dependent on a number of factors; most notably its primary sequence. In one embodiment, a lower degree of immunogenicity is achieved by designing XTEN sequences that resist antigen processing in antigen presenting cells, and/or choosing sequences that do not bind MHC receptors well. The invention provides GPXTEN fusion proteins with substantially non-repetitive XTEN polypeptides designed to reduce binding with MHC II receptors, as well as avoiding formation of epitopes for T-cell receptor or antibody binding, resulting in a low degree of immunogenicity. Avoidance of immunogenicity is, in part, a direct result of the conformational flexibility of XTEN sequences; i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of fusion proteins comprising XTEN, using conventional therapeutic practices and dosing, would generally not result in the formation of neutralizing antibodies to the XTEN sequence, and also reduce the immunogenicity of the GP fusion partner in the GPXTEN compositions.

In one embodiment, the XTEN sequences utilized in the subject fusion proteins can be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. Assays for human T cell epitopes have been described (Stickler, M., et al. (2003) *J Immunol Methods,* 281: 95-108). Of particular interest are peptide sequences that can be oligomerized without generating T cell epitopes or non-human sequences. This is achieved by testing direct repeats of these sequences for the presence of T-cell epitopes and for the occurrence of 6 to 15-mer and, in particular, 9-mer sequences that are not human, and then altering the design of the XTEN sequence to eliminate or disrupt the epitope sequence. In some embodiments, the XTEN sequences are substantially non-immunogenic by the restriction of the numbers of epitopes of the XTEN predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) Nat Biotechnol, 17: 555-61), as shown in Example 45. The TEPITOPE score of a given peptide frame within a protein is the log of the $K_d$ (dissociation constant, affinity, off-rate) of the binding of that peptide frame to multiple of the most common human MHC alleles, as disclosed in Sturniolo, T. et al. (1999) *Nature Biotechnology* 17:555). The score ranges over at least 20 logs, from about 10 to about −10 (corresponding to binding constraints of $10e^{10} K_d$ to $10e^{-10} K_d$, and can be reduced by avoiding hydrophobic amino acids that serve as anchor residues during peptide display on MHC, such as M, I, L, V, F. In some embodiments, an XTEN component incorporated into a GPXTEN does not have a predicted T-cell epitope at a TEPITOPE score of about −5 or greater, or −6 or greater, or −7 or greater, or −8 or greater, or at a TEPITOPE score of −9 or greater. As used herein, a score of "−9 or greater" would encompass TEPITOPE scores of 10 to −9, inclusive, but would not encompass a score of −10, as −10 is less than −9.

In another embodiment, the inventive XTEN sequences, including those incorporated into the subject GPXTEN fusion proteins, are rendered substantially non-immunogenic by the restriction of known proteolytic sites from the sequence of the XTEN, reducing the processing of XTEN into small peptides that can bind to MHC II receptors. In another embodiment, the XTEN sequence is rendered substantially non-immunogenic by the use a sequence that is substantially devoid of secondary structure, conferring resistance to many proteases due to the high entropy of the structure. Accordingly, the reduced TEPITOPE score and elimination of known proteolytic sites from the XTEN render the XTEN compositions, including the XTEN of the GPXTEN fusion protein compositions, substantially unable to be bound by mammalian receptors, including those of the immune system. In one embodiment, an XTEN of a GPXTEN fusion protein can have >100 nM $K_d$ binding to a mammalian receptor, or greater than 500 nM $K_d$, or greater than 1 μM $K_d$ towards a mammalian cell surface or circulating polypeptide receptor.

Additionally, the non-repetitive sequence and corresponding lack of epitopes of XTEN limit the ability of B cells to bind to or be activated by XTEN. A repetitive sequence is recognized and can form multivalent contacts with even a few B cells and, as a consequence of the cross-linking of multiple T-cell independent receptors, can stimulate B cell proliferation and antibody production. In contrast, while a XTEN can make contacts with many different B cells over its extended sequence, each individual B cell may only make one or a small number of contacts with an individual XTEN due to the lack of repetitiveness of the sequence. Not being to be bound by any theory, XTENs typically have a much lower tendency to stimulate proliferation of B cells and thus an immune response. In one embodiment, the GPXTEN may have reduced immunogenicity as compared to the corresponding GP that is not fused. In one embodiment, the administration of up to three parenteral doses of a GPXTEN to a mammal result in detectable anti-GPXTEN IgG at a serum dilution of 1:100 but not at a dilution of 1:1000. In another embodiment, the administration of up to three parenteral doses of an GPXTEN to a mammal may result in detectable anti-GP IgG at a serum dilution of 1:100 but not at a dilution of 1:1000. In another embodiment, the administration of up to three parenteral doses of a GPXTEN to a mammal result in detectable anti-GP IgG at a serum dilution of 1:100 but not at a dilution of 1:1000. In another embodiment, the administration of up to three parenteral doses of a GPXTEN to a mammal results in detectable anti-XTEN IgG at a serum dilution of 1:100 but not at a dilution of 1:1000. In the foregoing embodiments, the mammal can be a mouse, a rat, a rabbit, or a cynomolgus monkey.

An additional feature of XTENs with non-repetitive sequences relative to sequences with a high degree of repetitiveness is non-repetitive XTENs form weaker contacts with antibodies. Antibodies are multivalent molecules. For instance, IgGs have two identical binding sites and IgMs contain 10 identical binding sites. Thus antibodies against repetitive sequences can form multivalent contacts with such repetitive sequences with high avidity, which can affect the potency and/or elimination of such repetitive sequences. In contrast, antibodies against non-repetitive XTENs may yield monovalent interactions, resulting in less likelihood of immune clearance such that the GPXTEN compositions can remain in circulation for an increased period of time.

8. Increased Hydrodynamic Radius

In another aspect, the present invention provides XTEN in which the XTEN polypeptides have a high hydrodynamic radius that confers a corresponding increased Apparent Molecular Weight to the GPXTEN fusion protein incorporating the XTEN. As detailed in Example 22, the linking of XTEN to GP sequences can result in GPXTEN compositions that can have increased hydrodynamic radii, increased Apparent Molecular Weight, and increased Apparent Molecular Weight Factor compared to a GP not linked to an XTEN. For example, in therapeutic applications in which prolonged half-life is desired, compositions in which a XTEN with a high hydrodynamic radius is incorporated into a fusion protein comprising one or more GP can effectively enlarge the hydrodynamic radius of the composition beyond the glomerular pore size of approximately 3-5 nm (corresponding to an apparent molecular weight of about 70 kDA) (Caliceti. 2003. Pharmacokinetic and biodistribution properties of poly(ethylene glycol)-protein conjugates. Adv Drug Deliv Rev 55:1261-1277), resulting in reduced renal clearance of circulating proteins. The hydrodynamic radius of a protein is determined by its molecular weight as well as by its structure, including shape or compactness. Not to be bound by a particular theory, the XTEN can adopt open conformations due to electrostatic repulsion between individual charges of the peptide or the inherent flexibility imparted by the particular amino acids in the sequence that lack potential to confer secondary structure. The open, extended and unstructured conformation of the XTEN polypeptide can have a greater proportional hydrodynamic radius compared to polypeptides of a comparable sequence length and/or molecular weight that have secondary and/or tertiary structure, such as typical globular proteins. Methods for determining the hydrodynamic radius are well known in the art, such as by the use of size exclusion chromatography (SEC), as described in U.S. Pat. Nos. 6,406,632 and 7,294,513. As the results of Example 22 demonstrate, the addition of increasing lengths of XTEN results in proportional increases in the parameters of hydrodynamic radius, Apparent Molecular Weight, and Apparent Molecular Weight Factor, permitting the tailoring of GPXTEN to desired characteristic cut-off Apparent Molecular Weights or hydrodynamic radii. Accordingly, in certain embodiments, the GPXTEN fusion protein can be configured with an XTEN such that the fusion protein can have a hydrodynamic radius of at least about 5 nm, or at least about 8 nm, or at least about 10 nm, or 12 nm, or at least about 15 nm. In the foregoing embodiments, the large hydrodynamic radius conferred by the XTEN in an GPXTEN fusion protein can lead to reduced renal clearance of the resulting fusion protein, leading to a corresponding increase in terminal half-life, an increase in mean residence time, and/or a decrease in renal clearance rate.

In another embodiment, an XTEN of a chosen length and sequence can be selectively incorporated into a GPXTEN to create a fusion protein that have, under physiologic conditions, an Apparent Molecular Weight of at least about 150 kDa, or at least about 300 kDa, or at least about 400 kDa, or at least about 500 kDA, or at least about 600 kDa, or at least about 700 kDA, or at least about 800 kDa, or at least about 900 kDa, or at least about 1000 kDa, or at least about 1200 kDa, or at least about 1500 kDa, or at least about 1800 kDa, or at least about 2000 kDa, or at least about 2300 kDa or more. In another embodiment, an XTEN of a chosen length and sequence can be selectively linked to a GP to result in a GPXTEN fusion protein that has, under physiologic conditions, an Apparent Molecular Weight Factor of at least three, alternatively of at least four, alternatively of at least five, alternatively of at least six, alternatively of at least eight, alternatively of at least 10, alternatively of at least 15, or an Apparent Molecular Weight Factor of at least 20 or greater. In another embodiment, the GPXTEN fusion protein has, under physiologic conditions, an Apparent Molecular Weight Factor that is about 4 to about 20, or is about 6 to about 15, or is about 8 to about 12, or is about 9 to about 10 relative to the actual molecular weight of the fusion protein.

V) GPXTEN Structural Configurations and Properties

The GP of the subject compositions are not limited to native, full-length polypeptides, but also include recombinant versions as well as biologically and/or pharmacologically active variants or fragments thereof. For example, it will be appreciated that various amino acid deletions, insertions and substitutions can be made in the GP to create variants without departing from the spirit of the invention with respect to the biological activity or pharmacologic properties of the GP. Examples of conservative substitutions for amino acids in polypeptide sequences are shown in Table 6. However, in embodiments of the GPXTEN in which the sequence identity of the GP is less than 100% compared to a specific sequence disclosed herein, the invention contemplates substitution of any of the other 19 natural L-amino acids for a given amino acid residue of the given GP, which may be at any position within the sequence of the GP, including adjacent amino acid residues. If any one substitution results in an undesirable change in biological activity, then one of the alternative amino acids can be employed and the construct evaluated by the methods described herein, or using any of the techniques and guidelines for conservative and non-conservative mutations set forth, for instance, in U.S. Pat. No. 5,364,934, the contents of which is incorporated by reference in its entirety, or using methods generally known in the art. In addition, variants can include, for instance, polypeptides wherein one or more amino acid residues are added or deleted at the N- or C-terminus of the full-length native amino acid sequence of a GP that retains some if not all of the biological activity of the native peptide.

TABLE 6

Exemplary conservative amino acid substitutions

| Original Residue | Exemplary Substitutions |
|---|---|
| Ala (A) | val; leu; ile |
| Arg (R) | lys; gln; asn |
| Asn (N) | gln; his; lys; arg |
| Asp (D) | glu |
| Cys (C) | ser |
| Gln (Q) | asn |
| Glu (E) | asp |
| Gly (G) | pro |
| His (H) | asn: gln: lys: arg |
| xIle (I) | leu; val; met; ala; phe: norleucine |
| Leu (L) | norleucine: ile: val; met; ala: phe |
| Lys (K) | arg: gln: asn |
| Met (M) | leu; phe; ile |
| Phe (F) | leu: val: ile; ala |
| Pro (P) | gly |
| Ser (S) | thr |
| Thr (T) | ser |
| Trp (W) | tyr |
| Tyr (Y) | trp: phe: thr: ser |
| Val (V) | ile; leu; met; phe; ala; norleucine | a. GPXTEN Fusion Protein Configurations

The invention provides GPXTEN fusion protein compositions with the GP and XTEN components linked in specific N- to C-terminus configurations. In some embodiments, one or more GPs are linked to one or more XTENs, either at the N-terminus or at the C-terminus, with or without a spacer, to form a block copolymer, and the sequential arrangement of the GPs and the XTENs in the GPXTEN fusion protein are the same as the configuration known in the block copolymer chemistry. When there is more than one GP, XTEN, or spacer, each of the GP, the XTEN, or the spacer have the same or different sequences, and the GPs and/or XTENs are linked either continuos or alternately (regular or irregular). Thus, in all of the formulae provided herein, when there is more than one GP, XTEN, or spacer, each of the GP, XTEN, and spacer are the same or different. In some embodiments, the GPXTEN is a monomeric fusion protein with a GP linked to one XTEN polypeptide. In other cases, the GPXTEN is a monomeric fusion protein with a GP linked to two or more XTEN polypeptides. In still other embodiments, the GPXTEN is a monomeric fusion protein with two or more GP linked to one XTEN polypeptide. In still other embodiments, the GPXTEN is a monomeric fusion protein with two or more GP linked to two or more XTEN polypeptide. Table 7 provides non-limiting examples of configurations that are encompassed by the GPXTEN fusion proteins of the invention; numerous other variations will be apparent to the ordinarily skilled artisan, including the incorporation the spacer and cleavage sequences disclosed herein or known in the art.

TABLE 7

GPXTEN configurations

| Components | Configuration* |
|---|---|
| Single GP; Single XTEN | GP-XTEN |
| | XTEN-GP |
| Single GP; Multiple XTEN | XTEN-GP-XTEN |
| | GP-XTEN-XTEN |
| | XTEN-XTEN-GP |
| | XTEN-GP-XTEN-XTEN |
| | XTEN-XTEN-GP-XTEN |
| | XTEN-XTEN-GP-XTEN |
| Multiple GP, Single XTEN | GP-XTEN-GP |
| | XTEN-GP-GP |
| | GP-GP-XTEN |
| | GP-XTEN-GP-GP |
| Multiple GP; Multiple XTEN | GP-XTEN-GP-XTEN |
| | XTEN-GP-XTEN-GP |
| | XTEN-XTEN-GP-XTEN-GP |
| | XTEN-XTEN-GP-GP |
| | GP-XTEN-XTEN-GP |
| | GP-GP-XTEN-XTEN |
| | GP-GP-XTEN-XTEN-GP |
| | GP-XTEN-GP-XTEN-GP |

*Characterized as single for 1 component or multiple for 2 or more of that component
**Reflects N- to C-terminus configuration of the glucose regulating peptide and XTEN components The invention contemplates GPXTEN fusion proteins compositions comprising, but not limited to GP selected from the sequences of Tables 1-3 (or fragments or sequence variants thereof), XTEN selected from Table 5 (or sequence variants thereof) that are in a configuration shown in Table 7. Generally, the resulting GPXTEN will retains at least a portion of the biological activity of the corresponding GP not linked to the XTEN. In other embodiments, the GP component either becomes biologically active or has an increase in activity upon its release from the XTEN by cleavage of an optional cleavage sequence incorporated within spacer sequences into the GPXTEN, described more fully below.

In one embodiment of the GPXTEN composition, the invention provides a fusion protein of formula

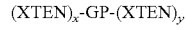    I wherein independently for each occurrence, GP is a is a glucose regulating peptide; x is either 0 or 1 and y is either 0 or 1 wherein x+y≥1; and XTEN is an extended recombinant polypeptide.

In another embodiment of the GPXTEN composition, the invention provides a fusion protein of formula II:

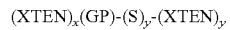    II wherein independently for each occurrence, GP is a is a glucose regulating peptide a; S is a spacer sequence having between 1 to about 50 amino acid residues that can optionally include a cleavage sequence; x is either 0 or 1 and y is either 0 or 1 wherein x+y≥1; and XTEN is an extended recombinant polypeptide.

In another embodiment, the invention provides an isolated fusion protein, wherein the fusion protein is of formula III:

$$(GP)-(S)_x-(XTEN)-(S)_y-(GP)-(S)_z-(XTEN)_z \quad \text{III}$$

wherein independently for each occurrence, GP is a is a glucose regulating peptide; S is a spacer sequence having between 1 to about 50 amino acid residues that can optionally include a cleavage sequence; x is either 0 or 1; y is either 0 or 1; z is either 0 or 1; and XTEN is an extended recombinant polypeptide.

In another embodiment, the invention provides an isolated fusion protein, wherein the fusion protein is of formula IV:

$$(XTEN)_x-(S)_y-(GP)-(S)_z-(XTEN)-(GP) \quad \text{IV}$$

wherein independently for each occurrence, GP is a is a glucose regulating peptide; S is a spacer sequence having between 1 to about 50 amino acid residues that can optionally include a cleavage sequence; x is either 0 or 1; y is either 0 or 1; z is either 0 or 1; and XTEN is an extended recombinant polypeptide.

In another embodiment, the invention provides an isolated fusion protein, wherein the fusion protein is of formula VIII:

$$((S)_m-(GP)_x-(S)_n-(XTEN)_y-(S)_o)_t \quad \text{VIII}$$

wherein t is an integer that is greater than 0 (1, 2, 3, 4, etc. . . . ); independently each of m, n, o, x, and y is an integer (0, 1, 2, 3, 4, etc.), GP is a is a glucose regulating peptide; S is an spacer, optionally comprising a cleavage site; and XTEN is an extended recombinant polypeptide, with the proviso that: (1) $x+y>1$, (2) when $t=1$, $x>0$ and $y>0$, (3) when there is more than one GP, S, or XTEN, each GP, XTEN, or S are the same or independently different; and (4) when $t>1$, each m, n, o, x, or y within each subunit are the same or are independently different.

In some cases, administration of a therapeutically effective dose of a fusion protein of an embodiment of formulas I-VIII to a subject in need thereof can result in a gain in time of at least two-fold, or at least three-fold, or at least four-fold, or at least five-fold or more spent within a therapeutic window for the fusion protein compared to the corresponding GP not linked to the XTEN of and administered at a comparable dose to a subject. In other cases, administration of a therapeutically effective dose of a fusion protein of an embodiment of formulas I-VIII to a subject in need thereof can result in a gain in time between consecutive doses necessary to maintain a therapeutically effective dose regimen of at least 48 h, or at least 72 h, or at least about 96 h, or at least about 120 h, or at least about 7 days, or at least about 14 days, or at least about 21 days between consecutive doses compared to a GP not linked to XTEN and administered at a comparable dose.

Any spacer sequence group is optional in the fusion proteins encompassed by the invention. The spacer may be provided to enhance expression of the fusion protein from a host cell or to decrease steric hindrance such that the GP component may assume its desired tertiary structure and/or interact appropriately with its target receptor. For spacers and methods of identifying desirable spacers, see, for example, George, et al. (2003) Protein Engineering 15:871-879, specifically incorporated by reference herein. In one embodiment, the spacer comprises one or more peptide sequences that are between 1-50 amino acid residues in length, or about 1-25 residues, or about 1-10 residues in length. Spacer sequences, exclusive of cleavage sites, can comprise any of the 20 natural L amino acids, and will preferably comprise hydrophilic amino acids that are sterically unhindered that can include, but not be limited to, glycine (G), alanine (A), serine (S), threonine (T), glutamate (E) and proline (P). In some cases, the spacer can be polyglycines or polyalanines, or is predominately a mixture of combinations of glycine and alanine residues. The spacer polypeptide exclusive of a cleavage sequence is largely to substantially devoid of secondary structure; e.g., less than about 10%, or less than about 5% as determined by the Chou-Fasman and/or GOR algorithms. In one embodiment, one or both spacer sequences in a GPXTEN fusion protein composition may each further contain a cleavage sequence, which may be identical or may be different, wherein the cleavage sequence may be acted on by a protease to release the GP from the fusion protein.

In some cases, the incorporation of the cleavage sequence into the GPXTEN is designed to permit release of a GP that becomes active or more active upon its release from the XTEN. The cleavage sequences are located sufficiently close to the GP sequences, generally within 18, or within 12, or within 6, or within 2 amino acids of the GP sequence terminus, such that any remaining residues attached to the GP after cleavage do not appreciably interfere with the activity (e.g., such as binding to a receptor) of the GP, yet provide sufficient access to the protease to be able to effect cleavage of the cleavage sequence. In some embodiments, the cleavage site is a sequence that can be cleaved by a protease endogenous to the mammalian subject such that the GPXTEN can be cleaved after administration to a subject. In such cases, the GPXTEN can serve as a prodrug or a circulating depot for the GP. Examples of cleavage sites contemplated by the invention include, but are not limited to, a polypeptide sequence cleavable by a mammalian endogenous protease selected from FXIa, FXIIa, kallikrein, FVIIa, FIXa, FXa, FIIa (thrombin), Elastase-2, granzyme B, MMP-12, MMP-13, MMP-17 or MMP-20, or by non-mammalian proteases such as TEV, enterokinase, PreScission™ protease (rhinovirus 3C protease), and sortase A. Sequences known to be cleaved by the foregoing proteases and others are known in the art. Exemplary cleavage sequences and cut sites within the sequences are presented in Table 8, as well as sequence variants. For example, thrombin (activated clotting factor II) acts on the sequence LTPRSLLV (SEQ ID NO: 210) [Rawlings N. D., et al. (2008) *Nucleic Acids Res.,* 36: D320], which would be cut after the arginine at position 4 in the sequence. Active FIIa is produced by cleavage of FII by FXa in the presence of phospholipids and calcium and is down stream from factor IX in the coagulation pathway. Once activated its natural role in coagulation is to cleave fibrinogen, which then in turn, begins clot formation. FIIa activity is tightly controlled and only occurs when coagulation is necessary for proper hemostasis. However, as coagulation is an on-going process in mammals, by incorporation of the LTPRSLLV (SEQ ID NO: 211) sequence into the GPXTEN between the GP and the XTEN, the XTEN domain would be removed from the adjoining GP concurrent with activation of either the extrinsic or intrinsic coagulation pathways when coagulation is required physiologically, thereby releasing GP over time. Similarly, incorporation of other sequences into GPXTEN that are acted upon by endogenous proteases would provide for sustained release of GP that may, in certain cases, provide a higher degree of activity for the GP from the "prodrug" form of the GPXTEN.

In some cases, only the two or three amino acids flanking both sides of the cut site (four to six amino acids total) would be incorporated into the cleavage sequence. In other cases, the known cleavage sequence can have one or more deletions or insertions or one or two or three amino acid substitutions for any one or two or three amino acids in the known sequence, wherein the deletions, insertions or substitutions result in reduced or enhanced susceptibility but not an absence of susceptibility to the protease, resulting in an ability to tailor the rate of release of the GP from the XTEN. Exemplary substitutions are shown in Table 8.

TABLE 8

Protease Cleavage Sequences

| Protease Acting Upon Sequence | Exemplary Cleavage Sequence | SEQ ID NO: | Minimal Cut Site* | SEQ ID NO: |
|---|---|---|---|---|
| FXIa | KLTR↓VVGG | 212 | KD/FL/T/R↓VA/VE/GT/GV | |
| FXIIa | TMTR↓IVGG | 213 | NA | |
| Kallikrein | SPFR↓STGG | 214 | -/-/FL/RY↓SR/RT/-/- | |
| FVIIa | LQVR↓IVGG | 215 | NA | |
| FIXa | PLGR↓IVGG | 216 | -/-/G/R↓-/-/-/- | |
| FXa | IEGR↓TVGG | 217 | IA/E/GFP/R↓STI/VFS/-/G | |
| FIIa (thrombin) | LTPR↓SLLV | 218 | -/-/PLA/R↓SAG/-/-/- | |
| Elastase-2 | LGPV↓SGVP | 219 | -/-/-VIAT↓-/-/-/- | |
| Granzyme-B | VAGD↓SLEE | 220 | V/-/-/D↓-/-/-/- | |
| MMP-12 | GPAG↓LGGA | 221 | G/PA/-/G↓L/-/G/- | 222 |
| MMP-13 | GPAG↓LRGA | 223 | G/P/-/G↓L/-/GA/- | 224 |
| MMP-17 | APLG↓LRLR | 225 | -/PS/-/-↓LQ/-/LT/- | |
| MMP-20 | PALP↓LVAQ | 226 | NA | |
| TEV | ENLYFQ↓G | 227 | ENLYFQ↓G/S | 228 |
| Enterokinase | DDDK↓IVGG | 229 | DDDK↓IVGG | 230 |
| Protease 3C (PreScission ™) | LEVLFQ↓GP | 231 | LEVLFQ↓GP | 232 |
| Sortase A | LPKT↓GSES | 233 | L/P/KEAD/T↓G/-/EKS/S | 234 |

↓indicates cleavage site
NA: not applicable
*the listing of multiple amino acids before, between, or after a slash indicate alternative amino acids that can be substituted at the position; "-" indicates that any amino acid may be substituted for the corresponding amino acid indicated in the middle column In one embodiment, a GP incorporated into a GPXTEN fusion protein can have a sequence that exhibits at least about 80% sequence identity to a sequence from Tables 1-3, alternatively at least about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99%, or about 100% sequence identity as compared with a sequence from Tables 1-3. The GP of the foregoing embodiment can be evaluated for activity using assays or measured or determined parameters as described herein, and those sequences that retain at least about 40%, or about 50%, or about 55%, or about 60%, or about 70%, or about 80%, or about 90%, or about 95% or more activity compared to the corresponding native GP sequence would be considered suitable for inclusion in the subject GPXTEN. The GP found to retain a suitable level of activity can be linked to one or more XTEN polypeptides described hereinabove. In one embodiment, a GP found to retain a suitable level of activity can be linked to one or more XTEN polypeptides having at least about 80% sequence identity to a sequence from Table 5, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as compared with a sequence of Table 5, resulting in a chimeric fusion protein.

Non-limiting examples of sequences of GPXTEN fusion proteins containing a single GP linked to a single XTEN are presented in Table 36, and sequences of GPXTEN fusion proteins containing a single GP linked to two XTEN are presented in Table 37. In one embodiment, a GPXTEN composition would comprise a fusion protein having at least about 80% sequence identity to a GPXTEN from Tables 36-37, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as compared with a GPXTEN from Tables 36-37. However, the invention also contemplates substitution of other GP with sequences exhibiting at least about 90% sequence identity to a sequence selected from Tables 1-3 linked to one or two XTEN, which may be the same or different, exhibiting at least about 90% sequence identity selected from Table 5. In the foregoing fusion proteins hereinabove described in this paragraph, the GPXTEN fusion protein can further comprise a cleavage sequence from Table 8; the cleavage sequence being located between the GP and the XTEN or between adjacent GP (if more than one GP is included in the GPXTEN). In some cases, the GPXTEN comprising the cleavage sequences will also have one or more'spacer sequence amino acids between the GP and the cleavage sequence or the XTEN and the cleavage sequence to facilitate access of the protease; the spacer amino acids comprising any natural amino acid, including glycine and alanine as preferred amino acids. Non-limiting examples of GPXTEN comprising GP, XTEN, cleavage sequence(s) and spacer amino acids are presented in Table 38. However, the invention also contemplates substitution of any of the GP sequences of Tables 1-3 for a GP sequence of Tables 36-38, substitution of any XTEN sequence of Table 5 for an XTEN sequence of Tables 36-38, and substitution of any cleavage sequence of Table 8 for a cleavage sequence of Table 38.

b. Pharmacokinetic Properties of GPXTEN

The invention provides GPXTEN fusion proteins with enhanced pharmacokinetics compared to the GP not linked to XTEN that, when used at the dose determined for the composition by the methods described herein, can achieve a circulating concentration resulting in a pharmacologic effect, yet stay within the safety range for biologically active component of the composition for an extended period of time compared to a comparable dose of the GP not linked to XTEN. In such cases, the GPXTEN remains within the therapeutic window for the fusion protein composition for the extended period of time. As used herein, a "comparable dose" means a dose with an equivalent moles/kg for the active GP pharmacophore that is administered to a subject in a comparable fashion. It will be understood in the art that a "comparable dosage" of GPXTEN fusion protein would represent a greater weight of agent but would have essentially the same mole-equivalents of GP in the dose of the fusion protein and/or would have the same approximate molar concentration relative to the GP.

The pharmacokinetic properties of a GP that can be enhanced by linking a given XTEN to the GP include terminal half-life, area under the curve (AUC), $C_{max}$ volume of distribution, and bioavailability providing enhanced utility in the treatment of glucose regulating peptide-related disorders, diseases and related conditions. The GP of the GPXTEN compositions exhibiting enhanced PK properties can be a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Tables 1-3, linked to one or more XTEN that exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Table 5, and can be in a configuration selected from the configurations of Table 7.

As described more fully in the Examples pertaining to pharmacokinetic characteristics of fusion proteins comprising XTEN, it was surprisingly discovered that increasing the length of the XTEN sequence could confer a disproportionate increase in the terminal half-life of a fusion protein comprising the XTEN. Accordingly, the invention provides GPXTEN fusion proteins comprising XTEN wherein the XTEN can be selected to provide a targeted half-life for the GPXTEN composition administered to a subject. In some embodiments, the invention provides monomeric fusion proteins comprising XTEN wherein the XTEN is selected to confer an increase in the terminal half-life for the GPXTEN administered to a subject, compared to the corresponding GP not linked to the fusion protein and administered at a comparable dose, of at least about two-fold longer, or at least about three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least a 40-fold, or at least a 80-fold, or at least a 100-fold or greater an increase in terminal half-life compared to the GP not linked to the fusion protein. Exogenously administered exendin-4 has been reported to have a terminal half-life in humans of 2.4 h and glucagon has a half-life of less than 20 minutes, whereas various GPXTEN compositions disclosed herein that have been experimentally administered to various animals species, as described in the Examples, have resulted in terminal half-life values of several hours. Similarly, the GPXTEN fusion proteins can have an increase in AUC of at least about 50%, or at least about 60%, or at least about 70%, or at least about 80%, or at least about 90%, or at least about a 100%, or at least about 150%, or at least about 200%, or at least about 300%, or at least about 500%, or at least about 1000%, or at least about a 2000% increase in AUC compared to the corresponding GP not linked to the fusion protein and administered to a subject at a comparable dose. The pharmacokinetic parameters of a GPXTEN can be determined by standard methods involving dosing, the taking of blood samples at times intervals, and the assaying of the protein using ELISA, HPLC, radioassay, or other methods known in the art or as described herein, followed by standard calculations of the data to derive the half-life and other PK parameters.

The invention further provides GPXTEN comprising a first and a second GP molecule, optionally separated by a spacer sequence that may further comprise a cleavage sequence, or separated by a second XTEN sequence. In one embodiment, the GP has less activity when linked to the fusion protein compared to a corresponding GP not linked to the fusion protein. In such case, as illustrated in FIG. 38, the GPXTEN can be designed such that upon administration to a subject, the GP component is gradually released by cleavage of the cleavage sequence(s), whereupon it regains activity or the ability to bind to its target receptor or ligand. Accordingly, the GPXTEN of the foregoing serves as a prodrug or a circulating depot, resulting in a longer terminal half-life compared to GP not linked to the fusion protein.

c. Pharmacology and Pharmaceutical Properties of GPXTEN

The present invention provides GPXTEN compositions comprising GP covalently linked to XTEN that can have enhanced properties compared to GP not linked to XTEN, as well as methods to enhance the therapeutic and/or biologic activity or effect of the respective two GP components of the compositions. In addition, the invention provides GPXTEN compositions with enhanced properties compared to those art-known fusion proteins containing immunoglobulin polypeptide partners, polypeptides of shorter length and/or polypeptide partners with repetitive sequences. In addition, GPXTEN fusion proteins provide significant advantages over chemical conjugates, such as pegylated constructs, notably the fact that recombinant GPXTEN fusion proteins can be made in bacterial cell expression systems, which can reduce time and cost at both the research and development and manufacturing stages of a product, as well as result in a more homogeneous, defined product with less toxicity for both the product and metabolites of the GPXTEN compared to pegylated conjugates.

As therapeutic agents, the GPXTEN may possess a number of advantages over therapeutics not comprising XTEN including one or more of the following non-limiting exemplary enhance properties; increased solubility, increased thermal stability, reduced immunogenicity, increased apparent molecular weight, reduced renal clearance, reduced proteolysis, reduced metabolism, enhanced therapeutic efficiency, a lower effective therapeutic dose, increased bioavailability, increased time between dosages capable of maintain blood levels within the therapeutic window for the GP, a "tailored" rate of absorption, enhanced lyophilization stability, enhanced serum/plasma stability, increased terminal half-life, increased solubility in blood stream, decreased binding by neutralizing antibodies, decreased receptor-mediated clearance, reduced side effects, retention of receptor/ligand binding affinity or receptor/ligand activation, stability to degradation, stability to freeze-thaw, stability to proteases, stability to ubiquitination, ease of administration, compatibility with other pharmaceutical excipients or carriers, persistence in the subject, increased stability in storage (e.g., increased shelf-life), reduced toxicity in an organism or environment and the like. The net effect of the enhanced properties is that the GPXTEN may result in enhanced therapeutic and/or biologic effect or improved patient compliance when administered to a subject with a glucose regulating peptide-related disease or disorder.

In other cases where, where enhancement of the pharmaceutical or physicochemical properties of the GP is desirable, (such as the degree of aqueous solubility or stability), the length and/or the motif family composition of the first and the second XTEN sequences of the first and the second fusion protein may each be selected to confer a different degree of solubility and/or stability on the respective fusion proteins such that the overall pharmaceutical properties of the GPXTEN composition are enhanced. The GPXTEN fusion proteins can be constructed and assayed, using methods described herein, to confirm the physicochemical properties and the XTEN adjusted, as needed, to result in the desired properties. In one embodiment, the XTEN sequence of the GPXTEN is selected such that the fusion protein has an aqueous solubility that is within at least about 25% greater compared to a GP not linked to the fusion protein, or at least about 30%, or at least about 40%, or at least about 50%, or at least about 75%, or at least about 100%, or at least about 200%, or at least about 300%, or at least about 400%, or at least about 500%, or at least about 1000% greater than the corresponding GP not linked to the fusion protein. In the embodiments hereinabove described in this paragraph, the XTEN of the fusion proteins can have at least about 80% sequence identity, or about 90%, or about 91%, or about 92%, or about 93%, or about 94%, or about 95%, or about 96%, or about 97%, or about 98%, or about 99%, to about 100% sequence identity to an XTEN selected from Table 5.

In one embodiment, the invention provides GPXTEN compositions that can maintain the GP component within a therapeutic window for a greater period of time compared to comparable dosages of the corresponding GP not linked to XTEN. It will be understood in the art that a "comparable dosage" of GPXTEN fusion protein would represent a greater weight of agent but would have the same approximate mole-equivalents of GP in the dose of the fusion protein and/or would have the same approximate molar concentration relative to the GP.

The invention also provides methods to select the XTEN appropriate for conjugation to provide the desired pharmacokinetic properties that, when matched with the selection of dose, enables increased efficacy of the administered composition by maintaining the circulating concentrations of the GP within the therapeutic window for an enhanced period of time. As used herein, "therapeutic window" means that the amount of drug or biologic as a blood or plasma concentration range, which provides efficacy or a desired pharmacologic effect over time for the disease or condition without unacceptable toxicity; the range of the circulating blood concentrations between the minimal amount to achieve any positive therapeutic effect and the maximum amount which results in a response that is the response immediately before toxicity to the subject (at a higher dose or concentration). Additionally, therapeutic window generally encompasses an aspect of time; the maximum and minimum concentration that results in a desired pharmacologic effect over time that does not result in unacceptable toxicity or adverse events. A dosed composition that stays within the therapeutic window for the subject could also be said to be within the "safety range."

The characteristics of GPXTEN compositions of the invention, including functional characteristics or biologic and pharmacologic activity and parameters that result, may be determined by any suitable screening assay known in the art for measuring the desired characteristic. The invention provides methods to assay the GPXTEN fusion proteins of differing composition or configuration in order to provide GPXTEN with the desired degree of biologic and/or therapeutic activity, as well as safety profile. Specific in vivo and ex vivo biological assays may be used to assess the activity of each configured GPXTEN and/or GP component to be incorporated into GPXTEN, including but not limited to the assays of the Examples, those assays of Table 35, as well as the following assays or other such assays known in the art for assaying the properties and effects of GP. Assays can be conducted that allow determination of binding characteristics of the GPXTEN for GP receptors or a ligand, including binding constant ($K_d$), $EC_{50}$ values, as well as their half-life of dissociation of the ligand-receptor complex ($T_{1/2}$). Binding affinity can be measured, for example, by a competition-type binding assay that detects changes in the ability to specifically bind to a receptor (see, e.g., Examples). Additionally, techniques such as flow cytometry or surface plasmon resonance can be used to detect binding events. The assays may comprise soluble receptor molecules, or may determine the binding to cell-expressed receptors. Such assays may include cell-based assays, including assays for calcium flux, signal transduction, and cell proliferation. Other possible assays may determine receptor binding of expressed polypeptides, wherein the assay may comprise soluble receptor molecules, or may determine the binding to cell-expressed receptors. The binding affinity of a GPXTEN for the target receptors of the corresponding GP can be assayed using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. In addition, GP sequence variants (assayed as single components or as GPXTEN fusion proteins) can be compared to the native GP using a competitive ELISA binding assay to determine whether they have the same binding specificity and affinity as the native GP, or some fraction thereof such that they are suitable for inclusion in GPXTEN. Functional assays can include insulin concentrations and/or generation within target cells as a result of exposure to GPXTEN, and/or the resulting stimulatory effects of beta cells, glucose uptake and/or homeostasis, HbA1c concentrations, insulin concentrations, stimulated C peptide, fasting plasma glucose (FPG), serum cytokine levels, CRP levels, insulin secretion and Insulin-sensitivity index derived from an oral glucose tolerance test (OGTT), as well as body weight, food consumption, and other accepted diabetic markers known in the art would be suitable parameters to assess the activity of GP for inclusion in the GPXTEN fusion protein or the resulting GPXTEN.

Dose optimization is important for all drugs, especially for those with a narrow therapeutic window. For example, a standardized single dose of GP for all patients presenting with a diverse symptoms or abnormal clinical parameters may not always be effective. A consideration of these factors is well within the purview of the ordinarily skilled clinician for the purpose of determining the therapeutically or pharmacologically effective amount of the GPXTEN, versus that amount that would result in unacceptable toxicity and place it outside of the safety range, or insufficient potency such that clinical improvement is not achieved.

In many cases, the therapeutic window for GP in subjects of different ages or degree of disease have been established and are available in published literature or are stated on the drug label for approved products containing the GP. In other cases, the therapeutic window can be established. The methods for establishing the therapeutic window for a given composition are known to those of skill in the art (see, e.g., Goodman & Gilman's The Pharmacological Basis of Therapeutics, 11$^{th}$ Edition, McGraw-Hill (2005)). For example, by using dose-escalation studies in subjects with the target disease or disorder to determine efficacy or a desirable pharmacologic effect, appearance of adverse events, and determination of circulating blood levels, the therapeutic window for a given subject or population of subjects can be determined for a given drug or biologic, or combinations of biologics or drugs. The dose escalation studies can evaluate the activity of a GPXTEN through metabolic studies in a subject or group of subjects that monitor physiological or biochemical parameters, as known in the art or as described herein for one or more parameters associated with the metabolic disease or disorder, or clinical parameters associated with a beneficial outcome for the particular indication, together with observations and/or measured parameters to determine the no effect dose, adverse events, maximum tolerated dose and the like, together with measurement of pharmacokinetic parameters that establish the determined or derived circulating blood levels. The results can then be correlated with the dose administered and the blood concentrations of the therapeutic that are coincident with the foregoing determined parameters or effect levels. By these methods, a range of doses and blood concentrations can be correlated to the minimum effective dose as well as the maximum dose and blood concentration at which a desired effect occurs and above which toxicity occurs, thereby establishing the therapeutic window for the dosed therapeutic. Blood concentrations of the fusion protein (or as measured by the GP component) above the maximum would be considered outside the therapeutic window or safety range. Thus, by the foregoing methods, a $C_{min}$ blood level would be established, below which the GPXTEN fusion protein would not have the desired pharmacologic effect, and a $C_{max}$ blood level would be established that would represent the highest circulating concentration before reaching a concentration that would elicit unacceptable side effects, toxicity or adverse events, placing it outside the safety range for the GPXTEN. With such concentrations established, the frequency of dosing and the dosage can be further refined by measurement of the $C_{max}$ and $C_{min}$ to provide the appropriate dose and dose frequency to keep the fusion protein(s) within the therapeutic window. One of skill in the art can, by the means disclosed herein or by other methods known in the art, confirm that the administered GPXTEN remains in the therapeutic window for the desired interval or requires adjustment in dose or length or sequence of XTEN. Further, the determination of the appropriate dose and dose frequency to keep the GPXTEN within the therapeutic window establishes the therapeutically effective dose regimen; the schedule for administration of multiple consecutive doses using a therapeutically effective dose of the fusion protein to a subject in need thereof resulting in consecutive $C_{max}$ peaks and/or $C_{min}$ troughs that remain within the therapeutic window and results in an improvement in at least one measured parameter relevant for the target disease, disorder or condition. In some cases, the GPXTEN administered at an appropriate dose to a subject may result in blood concentrations of the GPXTEN fusion protein that remains within the therapeutic window for a period at least about two-fold longer compared to the corresponding GP not linked to XTEN and administered at a comparable dose; alternatively at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer or greater compared to the corresponding GP not linked to XTEN and administered at a comparable dose. As used herein, an "appropriate dose" means a dose of a drug or biologic that, when administered to a subject, would result in a desirable therapeutic or pharmacologic effect and a blood concentration within the therapeutic window.

In one embodiment, the GPXTEN administered at a therapeutically effective dose regimen results in a gain in time of at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer between at least two consecutive $C_{max}$ peaks and/or $C_{min}$ troughs for blood levels of the fusion protein compared to the corresponding biologically active protein of the fusion protein not linked to the fusion protein and administered at a comparable dose regimen to a subject. In another embodiment, the GPXTEN administered at a therapeutically effective dose regimen results in a comparable improvement in one, or two, or three or more measured parameter using less frequent dosing or a lower total dosage in moles of the fusion protein of the pharmaceutical composition compared to the corresponding biologically active protein component(s) not linked to the fusion protein and administered to a subject using a therapeutically effective dose regimen for the GP. The measured parameters may include any of the clinical, biochemical, or physiological parameters disclosed herein, or others known in the art for assessing subjects with glucose- or insulin-related disorders.

The activity of the GPXTEN compositions of the invention, including functional characteristics or biologic and pharmacologic activity and parameters that result, may be determined by any suitable screening assay known in the art for measuring the desired characteristic. The activity and structure of the GPXTEN polypeptides comprising GP components may be assessed by measuring parameters described herein, by use of one or more assays selected from Table 35, assays of the Examples, or by methods known in the art to ascertain the degree of solubility, structure and retention of biologic activity. Assays can be conducted that allow determination of binding characteristics of the GPXTEN for GP receptors or a ligand, including binding constant ($K_d$), $EC_{50}$ values, as well as their half-life of dissociation of the ligand-receptor complex ($T_{1/2}$). Binding affinity can be measured, for example, by a competition-type binding assay that detects changes in the ability to specifically bind to a receptor or ligand (see, e.g., Examples). Additionally, techniques such as flow cytometry or surface plasmon resonance can be used to detect binding events. The assays may comprise soluble receptor molecules, or may determine the binding to cell-expressed receptors. Such assays may include cell-based assays, including assays for proliferation, cell death, apoptosis and cell migration. Other possible assays may determine receptor binding of expressed polypeptides, wherein the assay may comprise soluble receptor molecules, or may determine the binding to cell-expressed receptors. The binding affinity of a GPXTEN for the target receptors or ligands of the corresponding GP can be assayed using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. In addition, GP sequence variants (assayed as single components or as GPXTEN fusion proteins) can be compared to the native GP using a competitive ELISA binding assay to determine whether they have the same binding specificity and affinity as the native GP, or some fraction thereof such that they are suitable for inclusion in GPXTEN.

The invention provides isolated GPXTEN in which the binding affinity for GP target receptors or ligands by the GPXTEN can be at least about 10%, or at least about 20%, or at least about 30%, or at least about 40%, or at least about 50%, or at least about 60%, or at least about 70%, or at least about 80%, or at least about 90%, or at least about 95%, or at least about 99%, or at least about 100% or more of the affinity of a native GP not bound to XTEN for the target receptor or ligand. In some cases, the binding affinity $K_d$ between the subject GPXTEN and a native receptor or ligand of the GPXTEN is at least about $10^{-4}$M, alternatively at least about $10^{-5}$M, alternatively at least about $10^{-6}$M, or at least about $10^{-4}$M, or at least about $10^{-8}$M, or at least about $10^{-9}$M of the affinity between the GPXTEN and a native receptor or ligand.

In other cases, the invention provides isolated GPXTEN fusion proteins specifically designed to have reduced binding affinity to the GP receptor. In one em, such as fusion proteins comprising an XTEN fused to the C-terminus of the GP component. In some cases, the GPXTEN can be configured to have reduced binding affinity wherein the binding affinity is assessed by an in vitro cell receptor binding assay wherein the binding is reduced by about 10%, or about 20%, or about 40%, or about 60%, or about 80%, or about 90% compared to native GP. In other cases, the GPXTEN can be configured to have reduced binding affinity wherein the binding affinity is assessed by signal transduction wherein the GPXTEN fusion protein elicits less than about 80%, or less than about 60%, or less than about 40%, or less than about 20%, or less than about 10%, or less than about 5% activation of the signaling pathways of the cell with bound GPXTEN in comparison to those evoked by the native GP ligand. In the foregoing cases, the binding affinity is "substantially reduced." Non-limiting examples of specific constructs of such GPXTEN with reduced binding affinity include fusion proteins with at least about 80% sequence identity, or at least about 85% sequence identity, or at least about 90% sequence identity, or at least about 95% sequence identity, or at least about 97% sequence identity, or at least about 99% sequence identity to GP fusion proteins selected from AE912-GP-AE144, AE912-GP-AF144, AE912-GP-AE288, AM923-GP-AE144, AM923-GP-AF144, AM923-GP-AE288.

In some cases, the GPXTEN fusion proteins of the invention retain at least about 10%, or about 20%, 30%, 40%, 50%, 60%, 70%, 80%, 90%, 95%, 98%, or 99% percent of the biological activity of the corresponding GP not linked to the fusion protein with regard to an in vitro biologic activity or an in vivo pharmacologic effect known or associated with the use of the native GP in the treatment and prevention of metabolic conditions and disorders. Non-limiting examples of activities or pharmacologic effects that can be assayed to assess the retained activity of the GPXTEN fusion proteins include including assays for calcium flux and/or signal transduction in response to receptor binding, insulin concentrations and/or generation within target cells as a result of exposure to GPXTEN, and/or the resulting stimulatory effects of beta cells, glucose uptake and/or homeostasis, HbA1c concentrations, insulin concentrations, stimulated C peptide, fasting plasma glucose (FPG), serum cytokine levels, CRP levels, insulin secretion and Insulin-sensitivity index derived from an oral glucose tolerance test (OGTT), as well as body weight, food consumption, and other accepted diabetic markers known in the art would be suitable parameters to assess the activity of GP for inclusion in the GPXTEN fusion protein or the resulting GPXTEN.

In some cases of the foregoing embodiment, the activity of the GP component may be manifest by the intact GPXTEN fusion protein, while in other cases the activity of the GP component would be primarily manifested upon cleavage and release of the GP from the fusion protein by action of a protease that acts on a cleavage sequence incorporated into the GPXTEN fusion protein. In the foregoing, the GPXTEN can be designed to reduce the binding affinity of the GP component for the receptor or ligand when linked to the XTEN but have increased affinity when released from XTEN through the cleavage of cleavage sequence(s) incorporated into the GPXTEN sequence, as described more fully above.

In other cases, the GPXTEN can be designed to reduce binding affinity of the GP component to the GP receptor to increase the terminal half-life of GPXTEN administered to a subject by reducing receptor-mediated clearance; e.g., by adding an XTEN to the C-terminus of the GP component of the fusion protein. In other cases, the GPXTEN are designed to reduce the binding affinity of the GP component to the GP receptor to reduce toxicity or side effects due to the administered composition.

Accordingly, the invention provides a method for increasing the terminal half-life of a GPXTEN by producing a single-chain fusion protein construct with a specific N- to C-terminus configuration of the components comprising at least a first GP and a first and a second XTEN, wherein the fusion protein in a first N- to C-terminus configuration of the GP and XTEN components has reduced receptor-mediated clearance (RMC) and a corresponding increase in terminal half-life compared to a GPXTEN in a second N- to C-terminus configuration. In one embodiment of the foregoing, the GPXTEN is configured, N- to C-terminus as XTEN-GP-XTEN, which has reduced receptor binding compared to a GPXTEN configures, N- to C-terminus XTEN-GP. In another embodiment of the foregoing, the GPXTEN is configured GP-XTEN. In the foregoing embodiments, the two XTEN molecules can be identical or they can be of a different sequence composition or length. Non-limiting examples of the foregoing embodiment with two XTEN linked to a single GP include the constructs AE912-GP-AE144, AE912-GP-AE288, AE864-GP-AE144, AM923-GP-AE144, and AM923-GP-AE288. The invention contemplates other such constructs in which a GP from Tables 1-3 and XTEN from Table 5 are substituted for the respective components of the foregoing examples, and can be produced, for example, in a configuration from Table 7 such that the construct has reduced receptor mediated clearance compared to an alternate configuration of the respective components. In some cases, the foregoing method for increasing the terminal half-life provides configured GPXTEN that can result in an increase in the terminal half-life of at least about 50%, or about 75%, or about 100%, or about 150%, or about 200%, or about 300%, or about 400% or more compared to the half-life of a GPXTEN in a second configuration where receptor binding is not reduced. The invention takes advantage of the fact that certain ligands wherein reduced binding affinity to a receptor, either as a result of a decreased on-rate or an increased off-rate, may be effected by the obstruction of either the N- or C-terminus, and using that terminus as the linkage to another polypeptide of the composition, whether another molecule of a GP, an XTEN, or a spacer sequence results in the reduced binding affinity. The choice of the particular configuration of the GPXTEN fusion protein can reduce the degree of binding affinity to the receptor such that a reduced rate of receptor-mediated clearance can be achieved. Generally, activation of the receptor is coupled to RMC such that binding of a polypeptide to its receptor without activation does not lead to RMC, while activation of the receptor leads to RMC. However, in some cases, particularly where the ligand has an increased off rate, the ligand may nevertheless be able to bind sufficiently to initiate cell signaling without triggering receptor mediated clearance, with the net result that the GPXTEN remains bioavailable. In such cases, the configured GPXTEN has an increased half-life compared to those configurations that lead to a higher degree of RMC.

In cases where a reduction in binding affinity to a glucose regulating peptide receptor is desired in order to reduce receptor-mediated clearance but retention of at least a portion of the biological activity is desired, it will be clear that sufficient binding affinity to obtain the desired receptor activation must nevertheless be maintained e.g., by initiation of signal transduction. Thus, in one embodiment, the invention provides a GPXTEN configured such that the binding affinity of the GPXTEN for a target receptor is in the range of about 0.01%-40%, or about 0.1%-30%, or about 1%-20% of the binding affinity compared to a corresponding GPXTEN in a configuration wherein the binding affinity is not reduced. The binding affinity of the configured BXTEN is thus preferably reduced by at least about 60%, or at least about 70%, or at least about 80%, or at least about 90%, or at least about 95%, or at least about 99%, or at least about 99.99% as compared to the binding affinity of a corresponding GPXTEN in a configuration wherein the binding affinity of the GP component to the target receptor is not reduced or compared to the GP not linked to the fusion protein, determined under comparable conditions. Expressed differently, the GP component of the configured GPXTEN may have a binding affinity that is as small as about 0.01%, or at least about 0.1%, or at least about 1%, or at least about 2%, or at least about 3%, or at least about 4%, or at least about 5%, or at least about 10%, or at least about 20%, or at least about 30%, or at least 40% of that of the corresponding GP component of a GPXTEN in a configuration wherein the binding affinity of the GP component is not reduced. In the foregoing embodiments hereinabove described in this paragraph, the binding affinity of the configured GPXTEN for the target receptor would be "substantially reduced" compared to a corresponding native GP or a GPXTEN with a configuration in which the binding affinity of the corresponding GP component is not reduced. Accordingly, the present invention provides compositions and methods to produce compositions with reduced RMC by configuring the GPXTEN, examples of which were provided above, so as to be able to bind and activate a sufficient number of receptors to obtain a desired in vivo biological response yet avoid activation of more receptors than is required for obtaining such response. In the foregoing embodiments hereinabove described in this paragraph, the increased half-life can permit higher dosages and reduced frequency of dosing compared to GP not linked to XTEN or compared to GPXTEN configurations wherein the GP component retains sufficient biological or pharmacological activity to result in a composition with clinical efficacy maintained despite reduced dosing frequency.

VI) Uses of the Compositions of the Present Invention

In another aspect, the invention provides a method for achieving a beneficial effect in a disease, disorder or condition mediated by GP. The present invention addresses disadvantages and/or limitations of GP that have a relatively short terminal half-life and/or a narrow therapeutic window between the minimum effective dose and the maximum tolerated dose.

Most processes involved in glucose homeostasis are regulated by multiple peptides and hormones, and such peptides and hormones, as well as analogues thereof, have found utility in the treatment of glucose regulating peptide-related diseases, disorders and conditions. However, the use of commercially-available glucose regulating peptides, has met with less than optimal success in the management of subjects afflicted with such diseases, disorders and conditions. In particular, dose optimization and frequency of dosing is important for peptide and hormone biologics used in the treatment of glucose regulating peptide-related diseases and disorders. The fact that many glucose regulating peptides have a short half-life, necessitates frequent dosing in order to achieve clinical benefit, which results in difficulties in the management of such patients.

In one embodiment, the invention provides a method for achieving a beneficial affect in a subject with a glucose regulating peptide-related disease, disorder or condition comprising the step of administering to the subject a therapeutically- or prophylactically-effective amount of a GPXTEN wherein said administration results in the improvement of one or more biochemical or physiological parameters or clinical endpoints associated with a glucose regulating peptide-related disease, disorder or condition. The effective amount can produce a beneficial effect in helping to treat (e.g., cure or reduce the severity) or prevent (e.g., reduce the likelihood of onset or severity) a glucose regulating peptide-related disease, disorder or condition. In some cases, the method for achieving a beneficial effect can include administering a therapeutically effective amount of a GPXTEN fusion protein composition to treat a subject with a glucose regulating peptide-related disease, disorder, or condition, including, but not limited to, juvenile diabetes, type I diabetes, type II diabetes, obesity, acute hypoglycemia, acute hyperglycemia, nocturnal hypoglycemia, chronic hyperglycemia, glucagonomas, secretory disorders of the airway, arthritis, osteoporosis, central nervous system disease, restenosis, neurodegenerative disease, renal failure, congestive heart failure, nephrotic syndrome, cirrhosis, pulmonary edema, hypertension, and disorders wherein the reduction of food intake is desired, stroke, irritable bowel syndrome, myocardial infarction (e.g., reducing the morbidity and/or mortality associated therewith), stroke, acute coronary syndrome (e.g., characterized by an absence of Q-wave) myocardial infarction, post-surgical catabolic changes, hibernating myocardium or diabetic cardiomyopathy, insufficient urinary sodium excretion, excessive urinary potassium concentration, conditions or disorders associated with toxic hypervolemia, (e.g., renal failure, congestive heart failure, nephrotic syndrome, cirrhosis, pulmonary edema, and hypertension), polycystic ovary syndrome, respiratory distress, nephropathy, left ventricular systolic dysfunction, (e.g., with abnormal left ventricular ejection fraction), gastrointestinal disorders such as diarrhea, postoperative dumping syndrome and irritable bowel syndrome, (i.e., via inhibition of antro-duodenal motility), critical illness polyneuropathy (CIPN), dyslipidemia, organ tissue injury caused by reperfusion of blood flow following ischemia, and coronary heart disease risk factor (CHDRF) syndrome, and any other indication for which the unmodified glucose-regulating peptide (e.g. exendin-4, GLP-1 or glucagon) is utilized, or any other indication for which GP can be utilized (but for which endogenous glucose regulating peptide levels in a subject are not necessarily deficient).

In another embodiment, the invention provides a method of stimulating insulin secretion in subjects with a glucose regulating peptide-related disease, disorder or deficiency. The method comprises the step of administering therapeutically effective amount of GPXTEN to a subject that results in the increased blood levels and/or duration in increased blood levels of insulin compared to a subject receiving a GP not linked to an XTEN and administered at a comparable dose. In some cases, the increase in insulin secretion and/or area under the curve is at least about 20%, or at least about 30%, or at least about 40%, or at least about 50%, or at least about 75%, or at least about 100%, or at least about 200%, or at least about 300% compared to a subject receiving a GP not linked to an XTEN and administered at a comparable dose.

As a result of the enhanced PK parameters of GPXTEN, as described herein, the GP may be administered using longer intervals between doses compared to the corresponding GP not linked to XTEN to prevent, treat, alleviate, reverse or ameliorate symptoms or clinical abnormalities of the glucose regulating peptide-related disease, disorder or condition or prolong the survival of the subject being treated.

The methods of the invention may include administration of consecutive doses of a therapeutically effective amount of the GPXTEN for a period of time sufficient to achieve and/or maintain the desired parameter or clinical effect, and such consecutive doses of a therapeutically effective amount establishes the therapeutically effective dose regimen for the GPXTEN; i.e., the schedule for consecutively administered doses of the fusion protein composition, wherein the doses are given in therapeutically effective amounts to result in a sustained beneficial effect on any clinical sign or symptom, aspect, measured parameter or characteristic of a metabolic disease state or condition, including, but not limited to, those described herein. In one embodiment, the method comprises administering a therapeutically-effective amount of a pharmaceutical composition comprising a GPXTEN fusion protein composition comprising a GP linked to an XTEN sequence(s) and at least one pharmaceutically acceptable carrier to a subject in need thereof that results in greater improvement in at least one parameter, physiologic condition, or clinical outcome mediated by the GP component(s) (non-limiting examples of which are described above) compared to the effect mediated by administration of a pharmaceutical composition comprising a GP not linked to XTEN and administered at a comparable dose. In one embodiment, the pharmaceutical composition is administered at a therapeutically effective dose. In another embodiment, the pharmaceutical composition is administered using multiple consecutive doses using a therapeutically effective dose regimen (as defined herein) for the length of the dosing period.

A therapeutically effective amount of the GPXTEN may vary according to factors such as the disease state, age, sex, and weight of the individual, and the ability of the antibody or antibody portion to elicit a desired response in the individual. A therapeutically effective amount is also one in which any toxic or detrimental effects of the GPXTEN are outweighed by the therapeutically beneficial effects. A prophylactically effective amount refers to an amount of GPXTEN required for the period of time necessary to achieve the desired prophylactic result.

For the inventive methods, longer acting GPXTEN compositions are preferred, so as to improve patient convenience, to increase the interval between doses and to reduce the amount of drug required to achieve a sustained effect. In one embodiment, a method of treatment comprises administration of a therapeutically effective dose of a GPXTEN to a subject in need thereof that results in a gain in time spent within a therapeutic window established for the fusion protein of the composition compared to the corresponding GP component(s) not linked to the fusion protein and administered at a comparable dose to a subject. In some cases, the gain in time spent within the therapeutic window is at least about three-fold, or at least about four-fold, or at least about five-fold, or at least about six-fold, or at least about eight-fold, or at least about 10-fold, or at least about 20-fold, or at least about 40-fold compared to the corresponding GP component not linked to the fusion protein and administered at a comparable dose to a subject. The methods further provide that administration of multiple consecutive doses of a GPXTEN administered using a therapeutically effective dose regimen to a subject in need thereof can result in a gain in time between consecutive $C_{max}$ peaks and/or $C_{min}$ troughs for blood levels of the fusion protein compared to the corresponding GP not linked to the fusion protein and administered using a dose regimen established for that GP. In the foregoing embodiment, the gain in time spent between consecutive $C_{max}$ peaks and/or $C_{min}$ troughs can be at least about three-fold, or at least about four-fold, or at least about five-fold, or at least about six-fold, or at least about eight-fold, or at least about 10-fold, or at least about 20-fold, or at least about 40-fold compared to the corresponding GP component not linked to the fusion protein and administered using a dose regimen established for that GP. In the embodiments hereinabove described in this paragraph the administration of the fusion protein can result in an improvement in at least one of the parameters (disclosed herein as being useful for assessing the subject diseases, conditions or disorders) using a lower unit dose in moles of fusion protein compared to the corresponding GP component not linked to the fusion protein and administered at a comparable unit dose or dose regimen to a subject.

The method of treatment comprises administration of a GPXTEN using a therapeutically effective dose regimen to effect improvements in one or more parameters associated with glucose regulating peptide diseases, disorders or conditions. In some cases, administration of the GPXTEN to a subject can result in an improvement in one or more of the biochemical, physiologic, or clinical parameters that is of greater magnitude than that of the corresponding GP component not linked to XTEN, determined using the same assay or based on a measured clinical parameter. In other cases, administration of the GPXTEN to a subject can result in activity in one or more of the biochemical, physiologic, or clinical parameters that is of longer duration than the activity of one of the single GP components not linked to XTEN, determined using that same assay or based on a measured clinical parameter. In one embodiment of the foregoing, the administration of the GPXTEN to a subject can result in an improvement in peak concentrations and area under the curve of blood GP levels of at least about 10%, or about 20%, or about 30%, or about 40%, or about 50% or more in the subject compared to a comparable dose of GP not linked to XTEN administered to a subject. In another embodiment of the foregoing, the administration of the GPXTEN to a subject can result in an improvement in one or more parameters selected from, but not limited to HbA1c concentrations, insulin concentrations, stimulated C peptide, fasting plasma glucose (FPG), serum cytokine levels, CRP levels, insulin secretion and Insulin-sensitivity index derived from an oral glucose tolerance test (OGTT), body weight, and food consumption.

The invention further contemplates that GPXTEN used in accordance with the methods provided herein may be administered in conjunction with other treatment methods and pharmaceutical compositions useful for treating glucose regulating peptide-related diseases, disorders, and conditions, or conditions for which glucose regulating peptide is adjunctive therapy; e.g., insulin resistance and poor glycemic control. Such compositions, may include for example, DPP-IV inhibitors, insulin, insulin analogues, PPAR gamma agonists, dual-acting PPAR agonists, GLP-1 agonists or analogues, PTPIB inhibitors, SGLT inhibitors, insulin secretagogues, RXR agonists, glycogen synthase kinase-3 inhibitors, insulin sensitizers, immune modulators, beta-3 adrenergic receptor agonists, Pan-PPAR agonists, llbeta-HSDI inhibitors, biguanides, alpha-glucosidase inhibitors, meglitinides, thiazolidinediones, sulfonylureas and other diabetes medicants known in the art, or anti-hypertensive drugs, calcium channel blockers, and related products. In some cases, the administration of a GPXTEN may permit use of lower dosages of the co-administered pharmaceutical composition to achieve a comparable clinical effect or measured parameter for the disease, disorder or condition in the subject.

In another aspect, the invention provides a method of designing the GPXTEN compositions with desired pharmacologic or pharmaceutical properties. The GPXTEN fusion proteins are designed and prepared with various objectives in mind (compared to the GP components not linked to the fusion protein), including improving the therapeutic efficacy for the treatment of glucose regulating peptide-related diseases, disorders, and conditions, enhancing the pharmacokinetic characteristics of the fusion proteins compared to the GP, lowering the dose or frequency of dosing required to achieve a pharmacologic effect, enhancing the pharmaceutical properties, and to enhance the ability of the GP components to remain within the therapeutic window for an extended period of time.

Figure 4:
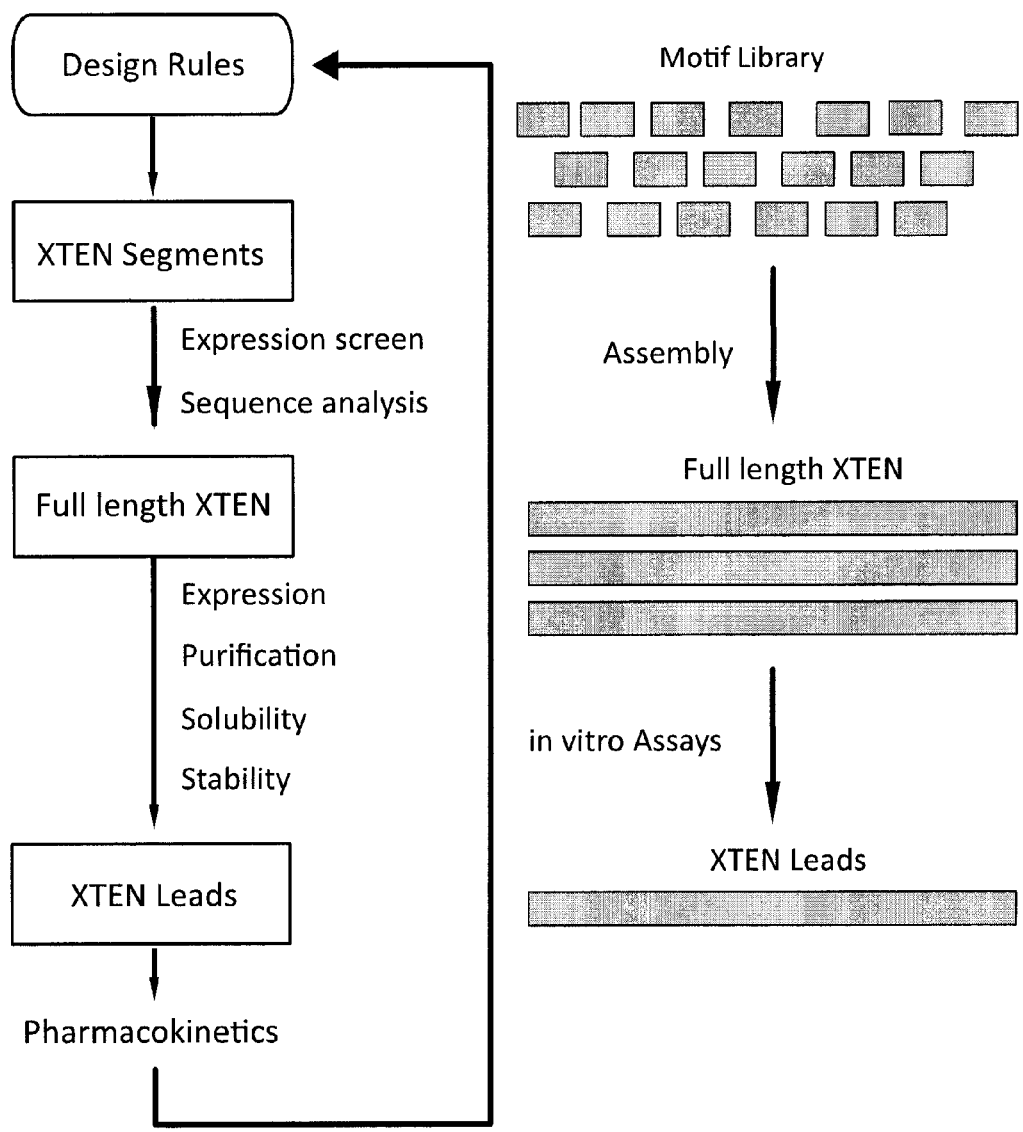
FIG. 4 is a schematic flowchart of representative steps in the assembly, production and the evaluation of a XTEN.
Figure 5:
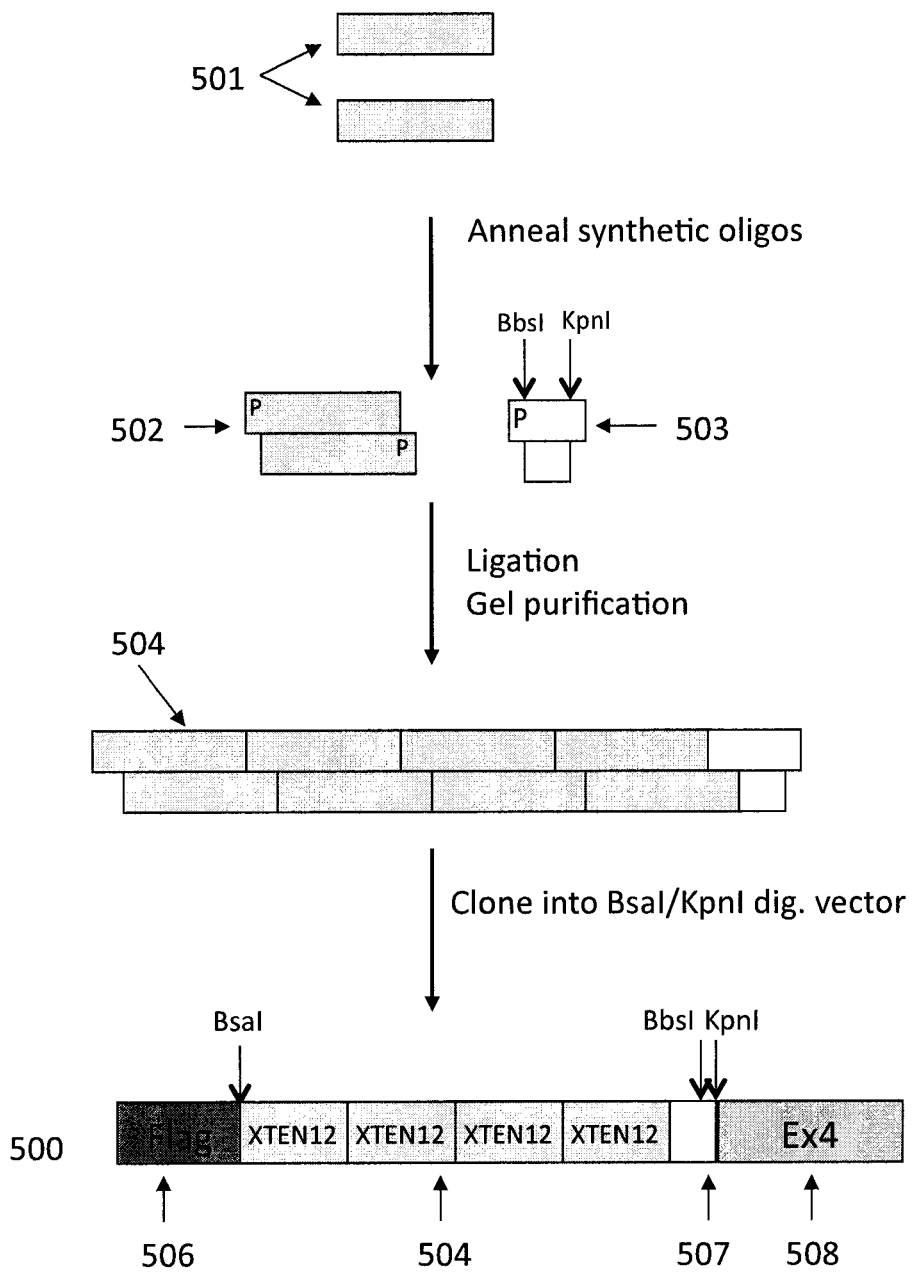
FIG. 5 is a schematic flowchart of representative steps in the assembly of a GP-XTEN polynucleotide construct encoding a fusion protein. Individual oligonucleotides 501 are annealed into sequence motifs 502 such as a 12 amino acid motif ("12-mer"), which is subsequently ligated with an oligo containing BbsI, and KpnI restriction sites 503. Additional sequence motifs from a library are annealed to the 12-mer until the desired length of the XTEN gene 504 is achieved. The XTEN gene is cloned into a stuffer vector. The vector encodes a Flag sequence 506 followed by a stopper sequence that is flanked by BsaI, BbsI, and KpnI sites 507 and an exendin-4 (Ex4) gene 508, resulting in the gene 500 encoding an GPXTEN fusion protein.
Figure 6:
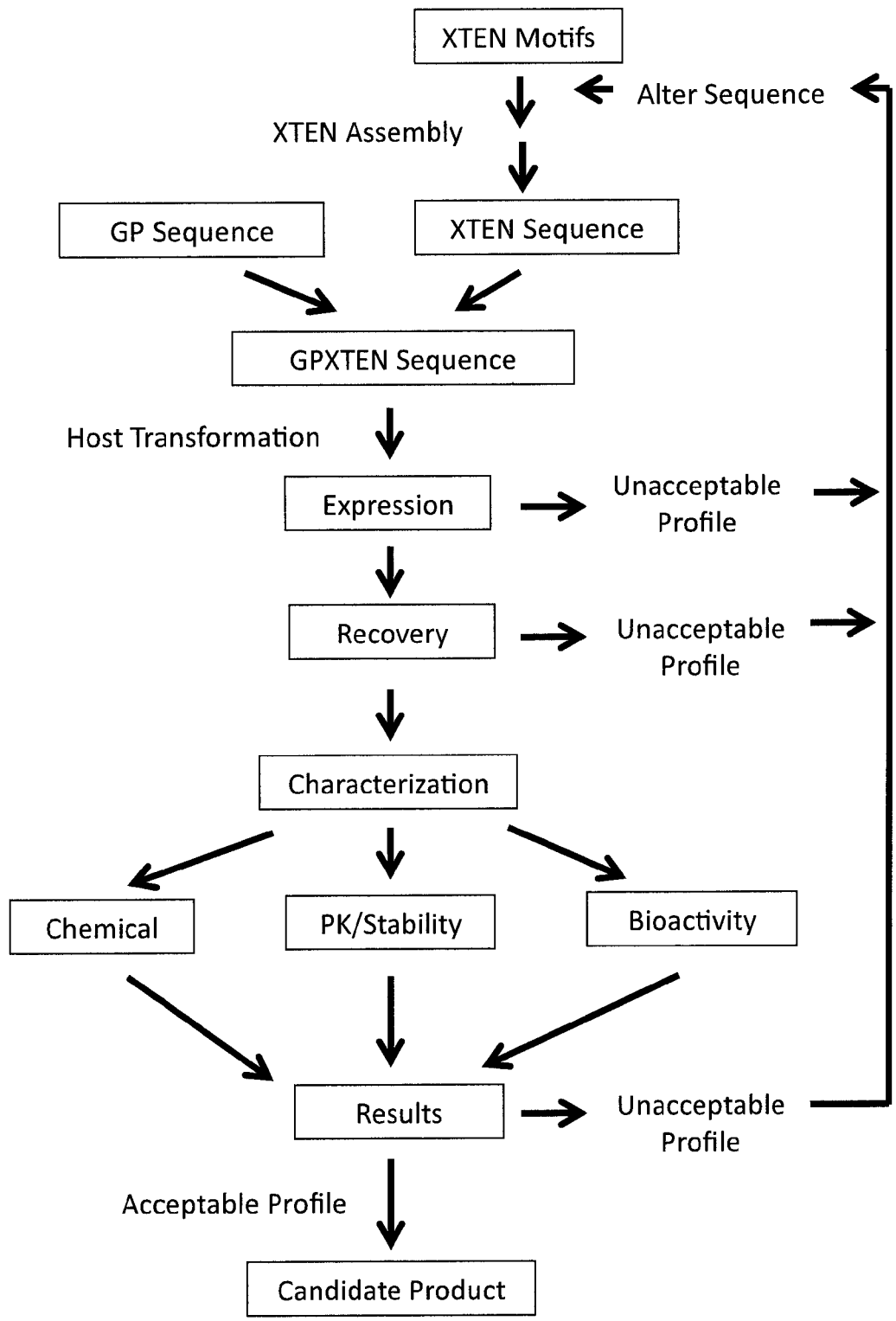
FIG. 6 is a schematic flowchart of representative steps in the assembly of a gene encoding fusion protein comprising a biologically active protein (GP) and XTEN, its expression and recovery as a fusion protein, and its evaluation as a candidate GPXTEN product.

In general, the steps in the design and production of the fusion proteins and the inventive compositions may, as illustrated in FIGS. 4-6, include: (1) the selection of GPs (e.g., native proteins, analogs or derivatives with activity) to treat the particular disease, disorder or condition; (2) selecting the XTEN that will confer the desired PK and physicochemical characteristics on the resulting GPXTEN (e.g., the administration of the composition to a subject results in the fusion protein being maintained within the therapeutic window for a greater period compared to GP not linked to XTEN); (3) establishing a desired N- to C-terminus configuration of the GPXTEN to achieve the desired efficacy or PK parameters; (4) establishing the design of the expression vector encoding the configured GPXTEN; (5) transforming a suitable host with the expression vector; and (6) expression and recovery of the resultant fusion protein. For those GPXTEN for which an increase in half-life (greater than 24 h) or an increased period of time spent within a therapeutic window is desired, the XTEN chosen for incorporation will generally have at least about 500, or about 576, or about 864, or about 875, or about 912, or about 923 amino acid residues where a single XTEN is to be incorporated into the GPXTEN. In another embodiment, the GPXTEN can comprise a first XTEN of the foregoing lengths, and a second XTEN of about 144, or about 288, or about 576, or about 864, or about 875, or about 912, or about 923 amino acid residues.

In other cases, where in increase in half-life is not required, but an increase in a pharmaceutical property (e.g., solubility) is desired, a GPXTEN can be designed to include XTEN of shorter lengths. In some embodiments of the foregoing, the GPXTEN can comprise a GP linked to an XTEN having at least about 24, or about 36, or about 48, or about 60, or about 72, or about 84, or about 96 amino acid residues, in which the solubility of the fusion protein under physiologic conditions is at least three-fold greater than the corresponding GP not linked to XTEN, or alternatively, at least four-fold, or five-fold, or six-fold, or seven-fold, or eight-fold, or nine-fold, or at least 10-fold, or at least 20-fold, or at least 30-fold, or at least 50-fold, or at least 60-fold or greater than GP not linked to XTEN. In one embodiment of the foregoing, the GP is glucagon.

In another aspect, the invention provides methods of making GPXTEN compositions to improve ease of manufacture, result in increased stability, increased water solubility, and/or ease of formulation, as compared to the native GP. In one embodiment, the invention includes a method of increasing the water solubility of a GP comprising the step of linking the GP to one or more XTEN such that a higher concentration in soluble form of the resulting GPXTEN can be achieved, under physiologic conditions, compared to the GP in an un-fused state. Factors that contribute to the property of XTEN to confer increased water solubility of GPs when incorporated into a fusion protein include the high solubility of the XTEN fusion partner and the low degree of self-aggregation between molecules of XTEN in solution. In some embodiments, the method results in a GPXTEN fusion protein wherein the water solubility is at least about 20%, or at least about 30% greater, or at least about 50% greater, or at least about 75% greater, or at least about 90% greater, or at least about 100% greater, or at least about 150% greater, or at least about 200% greater, or at least about 400% greater, or at least about 600% greater, or at least about 800% greater, or at least about 1000% greater, or at least about 2000% greater, or at least about 4000% greater, or at least about 6000% greater under physiologic conditions, compared to the un-fused GP.

In another embodiment, the invention includes a method of enhancing the shelf-life of a GP comprising the step of linking the GP with one or more XTEN selected such that the shelf-life of the resulting GPXTEN is extended compared to the GP in an un-fused state. As used herein, shelf-life refers to the period of time over which the functional activity of a GP or GPXTEN that is in solution or in some other storage formulation remains stable without undue loss of activity. As used herein, "functional activity" refers to a pharmacologic effect or biological activity, such as the ability to bind a receptor or ligand, or an enzymatic activity, or to display one or more known functional activities associated with a GP, as known in the art. A GP that degrades or aggregates generally has reduced functional activity or reduced bioavailability compared to one that remains in solution. Factors that contribute to the ability of the method to extend the shelf life of GPs when incorporated into a fusion protein include the increased water solubility, reduced self-aggregation in solution, and increased heat stability of the XTEN fusion partner. In particular, the low tendency of XTEN to aggregate facilitates methods of formulating pharmaceutical preparations containing higher drug concentrations of GPs, and the heat-stability of XTEN contributes to the property of GPXTEN fusion proteins to remain soluble and functionally active for extended periods. In one embodiment, the method results in GPXTEN fusion proteins with "prolonged" or "extended" shelf-life that exhibit greater activity relative to a standard that has been subjected to the same storage and handling conditions. The standard may be the un-fused full-length GP. In one embodiment, the method includes the step of formulating the isolated GPXTEN with one or more pharmaceutically acceptable excipients that enhance the ability of the XTEN to retain its unstructured conformation and for the GPXTEN to remain soluble in the formulation for a time that is greater than that of the corresponding un-fused GP. In one embodiment, the method comprises linking a GP to one or more XTEN to create a GPXTEN fusion protein results in a solution that retains greater than about 100% of the functional activity, or greater than about 105%, 110%, 120%, 130%, 150% or 200% of the functional activity of a standard when compared at a given time point and when subjected to the same storage and handling conditions as the standard, thereby enhancing its shelf-life.

Shelf-life may also be assessed in terms of functional activity remaining after storage, normalized to functional activity when storage began. GPXTEN fusion proteins of the invention with prolonged or extended shelf-life as exhibited by prolonged or extended functional activity may retain about 50% more functional activity, or about 60%, 70%, 80%, or 90% more of the functional activity of the equivalent GP not linked to XTEN when subjected to the same conditions for the same period of time. For example, a GPXTEN fusion protein of the invention comprising exendin-4 fused to one or more XTEN sequences may retain about 80% or more of its original activity in solution for periods of up to 2 weeks, or 4 weeks, or 6 weeks or longer under various temperature conditions. In some embodiments, the GPXTEN retains at least about 50%, or about 60%, or at least about 70%, or at least about 80%, and most preferably at least about 90% or more of its original activity in solution when heated at 80° C. for 10 min. In other embodiments, the GPXTEN retains at least about 50%, preferably at least about 60%, or at least about 70%, or at least about 80%, or alternatively at least about 90% or more of its original activity in solution when heated or maintained at 37° C. for about 7 days. In another embodiment, GPXTEN fusion protein retains at least about 80% or more of its functional activity after exposure to a temperature of about 30° C. to about 70° C. over a period of time of about one hour to about 18 hours. In the foregoing embodiments hereinabove described in this paragraph, the retained activity of the GPXTEN would be at least about two-fold, or at least about three-fold fold, or at least about four-fold, or at least about five-fold, or at least about six-fold greater at a given time point than that of the corresponding GP not linked to the fusion protein.

VII) The Nucleic Acids Sequences of the Invention

The present invention provides isolated polynucleic acids encoding GPXTEN chimeric fusion proteins and sequences complementary to polynucleic acid molecules encoding GPXTEN chimeric fusion proteins, including homologous variants thereof. In another aspect, the invention encompasses methods to produce polynucleic acids encoding GPXTEN chimeric fusion proteins and sequences complementary to polynucleic acid molecules encoding GPXTEN chimeric fusion protein, including homologous variants thereof. In general, and as illustrated in FIGS. 4-6, the methods of producing a polynucleotide sequence coding for a GPXTEN fusion protein and expressing the resulting gene product include assembling nucleotides encoding GP and XTEN, ligating the components in frame, incorporating the encoding gene into an expression vector appropriate for and that can be recognized by a host cell, transforming the appropriate host cell with the expression vector, and culturing the host cell under conditions causing or permitting the fusion protein to be expressed in the transformed host cell, thereby producing the biologically-active GPXTEN polypeptide, which can be recovered as an isolated fusion protein by standard protein purification methods known in the art. Standard recombinant techniques in molecular biology can be used to make the polynucleotides and expression vectors of the present invention, and can be applied in the methods to create the polynucleotides, genes and expression vectors encoding the GPXTEN disclosed herein.

In accordance with the invention, nucleic acid sequences that encode GPXTEN (or its complement) may be used to generate recombinant DNA molecules that direct the expression of GPXTEN fusion proteins in appropriate host cells. Several cloning strategies are envisioned to be suitable for performing the present invention, many of which can be used to generate a construct that comprises a gene coding for a fusion protein of the GPXTEN composition of the present invention, or its complement. In some cases, the cloning strategy would be used to create a gene that encodes a monomeric GPXTEN that comprises at least a first GP and at least a first XTEN polypeptide, or their complement. In one embodiment of the foregoing, the gene would comprise a sequence encoding a GP or sequence variant. In other cases, the cloning strategy would be used to create a gene that encodes a monomeric GPXTEN that comprises nucleotides encoding at least a first molecule of GP or its complement and a first and at least a second XTEN or their complement that would be used to transform a host cell for expression of the fusion protein of the GPXTEN composition. In the foregoing embodiments hereinabove described in this paragraph, the genes can further comprise nucleotides encoding spacer sequences that may also encode cleavage sequence(s).

In designing a desired XTEN sequences, it was discovered that the non-repetitive nature of the XTEN of the inventive compositions can be achieved despite use of a "building block" molecular approach in the creation of the XTEN-encoding sequences. This was achieved by the use of a library of polynucleotides encoding peptide sequence motifs, described above, that are then ligated and/or multimerized to create the genes encoding the XTEN sequences (see FIGS. 4 and 5 and Examples). Thus, while the XTEN(s) of the expressed fusion protein may consist of multiple units of as few as four different sequence motifs, because the motifs themselves consist of non-repetitive amino acid sequences, the overall XTEN sequence is rendered non-repetitive. Accordingly, in one embodiment, the XTEN-encoding polynucleotides comprise multiple polynucleotides that encode non-repetitive sequences, or motifs, operably linked in frame and in which the resulting expressed XTEN amino acid sequences are non-repetitive.

In one approach, a construct is first prepared containing the DNA sequence corresponding to GPXTEN fusion protein. DNA encoding the GP of the compositions may be obtained from a cDNA library prepared using standard methods from tissue or isolated cells believed to possess GP mRNA and to express it at a detectable level. Libraries can be screened with probes containing, for example, about 20 to 100 bases designed to identify the GP gene of interest by hybridization using conventional molecular biology techniques. The best candidates for probes are those that represent sequences that are highly homologous for the given glucose regulating peptide, and should be of sufficient length and sufficiently unambiguous that false positives are minimized, but may be degenerate at one or more positions. If necessary, the coding sequence can be obtained using conventional primer extension procedures as described in Sambrook, et al., supra, to detect precursors and processing intermediates of mRNA that may not have been reverse-transcribed into cDNA. One can then use polymerase chain reaction (PCR) methodology to amplify the target DNA or RNA coding sequence to obtain sufficient material for the preparation of the GPXTEN constructs containing the GP gene(s). Assays can then be conducted to confirm that hybridizing full-length genes are the desired GP gene(s). By these conventional methods, DNA can be conveniently obtained from a cDNA library prepared from such sources. The GP encoding gene(s) may also be obtained from a genomic library or created by standard synthetic procedures known in the art (e.g., automated nucleic acid synthesis using, for example one of the methods described in Engels et al. (Agnew. Chem. Int. Ed. Engl., 28:716-734 1989)), using DNA sequences obtained from publicly available databases, patents, or literature references. Such procedures are well known in the art and well described in the scientific and patent literature. For example, sequences can be obtained from Chemical Abstracts Services (CAS) Registry Numbers (published by the American Chemical Society) and/or GenBank Accession Numbers (e.g., Locus ID, NP_XXXXX, and XP_XXXXX) Model Protein identifiers available through the National Center for Biotechnology Information (NCBI) webpage, available on the world wide web at ncbi.nlm.nih.gov that correspond to entries in the CAS Registry or GenBank database that contain an amino acid sequence of the protein of interest or of a fragment or variant of the protein. For such sequence identifiers provided herein, the summary pages associated with each of these CAS and GenBank and GenSeq Accession Numbers as well as the cited journal publications (e.g., PubMed ID number (PMID)) are each incorporated by reference in their entireties, particularly with respect to the amino acid sequences described therein. In one embodiment, the GP encoding gene encodes a protein from any one of Tables 1-3, or a fragment or variant thereof.

A gene or polynucleotide encoding the GP portion of the subject GPXTEN protein, in the case of an expressed fusion protein that will comprise a single GP can be then be cloned into a construct, which can be a plasmid or other vector under control of appropriate transcription and translation sequences for high level protein expression in a biological system. In a later step, a second gene or polynucleotide coding for the XTEN is genetically fused to the nucleotides encoding the N- and/or C-terminus of the GP gene by cloning it into the construct adjacent and in frame with the gene(s) coding for the GP. This second step can occur through a ligation or multimerization step. In the foregoing embodiments hereinabove described in this paragraph, it is to be understood that the gene constructs that are created can alternatively be the complement of the respective genes that encode the respective fusion proteins.

The gene encoding for the XTEN can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate short sequences of polynucleotides encoding XTEN into longer XTEN genes of a desired length and sequence. In one embodiment, the method ligates two or more codon-optimized oligonucleotides encoding XTEN motif or segment sequences of about 9 to 14 amino acids, or about 12 to 20 amino acids, or about 18 to 36 amino acids, or about 48 to about 144 amino acids, or about 144 to about 288 or longer, or any combination of the foregoing ranges of motif or segment lengths.

Alternatively, the disclosed method can be used to multimerize XTEN-encoding sequences into longer sequences of a desired length; e.g., a gene encoding 36 amino acids of XTEN can be dimerized into a gene encoding 72 amino acids, then 144, then 288, etc. Even with multimerization, XTEN polypeptides can be constructed such that the XTEN-encoding gene has low or virtually no repetitiveness through design of the codons selected for the motifs of the shortest unit used, which can reduce recombination and increase stability of the encoding gene in the transformed host. Genes encoding XTEN with non-repetitive sequences can be assembled from oligonucleotides using standard techniques of gene synthesis. The gene design can be performed using algorithms that optimize codon usage and amino acid composition. In one method of the invention, a library of relatively short XTEN-encoding polynucleotide constructs is created and then assembled, as illustrated in FIGS. 4 and 5. This can be a pure codon library such that each library member has the same amino acid sequence but many different coding sequences are possible. Such libraries can be assembled from partially randomized oligonucleotides and used to generate large libraries of XTEN segments comprising the sequence motifs. The randomization scheme can be optimized to control amino acid choices for each position as well as codon usage. Exemplary methods to achieve the foregoing are disclosed in the Examples.

a. Polynucleotide Libraries

In another aspect, the invention provides libraries of polynucleotides that encode XTEN sequences that can be used to assemble genes that encode XTEN of a desired length and sequence.

In certain embodiments, the XTEN-encoding library constructs comprise polynucleotides that encode polypeptide segments of a fixed length. As an initial step, a library of oligonucleotides that encode motifs of 9-14 amino acid residues can be assembled. In a preferred embodiment, libraries of oligonucleotides that encode motifs of 12 amino acids are assembled.

The XTEN-encoding sequence segments can be dimerized or multimerized into longer encoding sequences. Dimerization or multimerization can be performed by ligation, overlap extension, PCR assembly or similar cloning techniques known in the art. This process of can be repeated multiple times until the resulting XTEN-encoding sequences have reached the organization of sequence and desired length, providing the XTEN-encoding genes. As will be appreciated, a library of polynucleotides that encodes, e.g., 12 amino acid motifs can be dimerized and/or ligated into a library of polynucleotides that encode 36 amino acids. Libraries encoding motifs of different lengths; e.g., 9-14 amino acid motifs leading to libraries encoding 27 to 42 amino acids are contemplated by the invention. In turn, the library of polynucleotides that encode 27 to 42 amino acids, and preferably 36 amino acids (as described in the Examples) can be serially dimerized into a library containing successively longer lengths of polynucleotides that encode XTEN sequences of a desired length for incorporation into the gene encoding the GPXTEN fusion protein, as disclosed herein. In some embodiments, libraries can be assembled of polynucleotides that encode amino acids that are limited to specific sequence XTEN families; e.g., AD, AE, AF, AG, AM, or AQ sequences of Table 1. In other embodiments, libraries can comprises sequences that encode two or more of the motif family sequences from Table 1. The names and sequences of representative, non-limiting polynucleotide sequences of libraries that encode 36 mers are presented in Tables 10-13, and the methods used to create them are described more fully in the Examples. In other cases, libraries that encode XTEN can be constructed from segments of polynucleotide codons linked in a randomized sequence that encode amino acids wherein at least about 80%, or at least about 90%, or at least about 91%, or at least about 92%, or at least about 93%, or at least about 94%, or at least about 95%, or at least about 97%, or at least about 98%, or at least about 99% of the codons are selected from the group consisting of codons for glycine (G), alanine (A), serine (S), threonine (T), glutamate (E) and proline (P) amino acids. The libraries can be used, in turn, for serial dimerization or ligation to achieve polynucleotide sequence libraries that encode XTEN sequences, for example, of 48, 72, 144, 288, 576, 864, 912, 923, 1318 amino acids, or up to a total length of about 3000 amino acids, as well as intermediate lengths, in which the encoded XTEN can have one or more of the properties disclosed herein, when expressed as a component of a GPXTEN fusion protein. In some cases, the polynucleotide library sequences may also include additional bases used as "sequencing islands," described more fully below.

FIG. 5 is a schematic flowchart of representative, non-limiting steps in the assembly of a XTEN polynucleotide construct and a GPXTEN polynucleotide construct in the embodiments of the invention. Individual oligonucleotides 501 can be annealed into sequence motifs 502 such as a 12 amino acid motif ("12-mer"), which is subsequently ligated with an oligo containing BbsI, and KpnI restriction sites 503. Additional sequence motifs from a library are annealed to the 12-mer until the desired length of the XTEN gene 504 is achieved. The XTEN gene is cloned into a stuffer vector. The vector can optionally encode a Flag sequence 506 followed by a stuffer sequence that is flanked by BsaI, BbsI, and KpnI sites 507 and, in this case, a single GP gene (encoding Ex4 in this example) 508, resulting in the gene encoding a GPXTEN comprising a single GP 500. A non-exhaustive list of the XTEN names for polynucleotides encoding XTEN and precursor sequences is provided in Table 9.

TABLE 9

DNA nucleotide sequences of XTEN and precursor sequences

| XTEN Name | DNA Nucleotide Sequence | SEQ ID NO: |
|---|---|---|
| AE48 | ATGGCTGAACCTGCTGGCTCTCCAACCTCCACTGAGGAAGGTACCCCGGGTAGCGGTACTGCTT CTTCCTCTCCAGGTAGCTCTACCCCTTCTGGTGCAACCGGCTCTCCAGGTGCTTCTCCGGGCAC CAGCTCTACCGGTTCT | 235 |
| AM48 | ATGGCTGAACCTGCTGGCTCTCCAACCTCCACTGAGGAAGGTGCATCCCCGGGCACCAGCTCTA CCGGTTCTCCAGGTAGCTCTACCCCGTCTGGTGCTACCGGCTCTCCAGGTAGCTCTACCCCGTC TGGTGCTACTGGCTCT | 236 |
| AE144 | GGTAGCGAACCGGCAACTTCCGGCTCTGAAACCCCAGGTACTTCTGAAAGCGCTACTCCTGAGT CTGGCCCAGGTAGCGAACCTGCTACCTCTGGCTCTGAAACCCCAGGTAGCCCGGCAGGCTCTCC GACTTCCACCGAGGAAGGTACCTCTACTGAACCTTCTGAGGGTAGCGCTCCAGGTAGCGAACCG GCAACCTCTGGCTCTGAAACCCCAGGTAGCGAACCTGCTACCTCCGGCTCTGAAACTCCAGGTA GCGAACCGGCTACTTCCGGTTCTGAAACTCCAGGTACCTCTACCGAACCTTCCGAAGGCAGCGC ACCAGGTACTTCTGAAAGCGCAACCCCTGAATCCGGTCCAGGTAGCGAACCGGCTACTTCTGGC TCTGAGACTCCAGGTACTTCTACCGAACCGTCCGAAGGTAGCGCACCA | 237 |
| AF144 | GGTACTTCTACTCCGGAAAGCGGTTCCGCATCTCCAGGTACTTCTCCTAGCGGTGAATCTTCTAC TGCTCCAGGTACCTCTCCTAGCGGCGAATCTTCTACTGCTCCAGGTTCTACCAGCTCTACCGCTG AATCTCCTGGCCCAGGTTCTACCAGCGAATCCCCGTCTGGCACCGCACCAGGTTCTACTAGCTCT ACCGCAGAATCTCCGGGTCCAGGTACTTCCCCTAGCGGTGAATCTTCTACTGCTCCAGGTACCTC TACTCCGGAAAGCGGCTCCGCATCTCCAGGTTCTACTAGCTCTACTGCTGAATCTCCTGGTCCAG GTACCTCCCCTAGCGGCGAATCTTCTACTGCTCCAGGTACCTCTCCTAGCGGCGAATCTTCTACC GCTCCAGGTACCTCCCCTAGCGGTGAATCTTCTACCGCACCA | 238 |
| AE288 | GGTACCTCTGAAAGCGCAACTCCTGAGTCTGGCCCAGGTAGCGAACCTGCTACCTCCGGCTCTGA GACTCCAGGTACCTCTGAAAGCGCAACCCCGGAATCTGGTCCAGGTAGCGAACCTGCAACCTCTG GCTCTGAAACCCCAGGTACCTCTGAAAGCGCTACTCCTGAATCTGGCCCAGGTACTTCTACTGAA CCGTCCGAGGGCAGCGCACCAGGTAGCCCTGCTGGCTCTCCAACCTCCACCGAAGAAGGTACCTC TGAAAGCGCAACCCCTGAATCCGGCCCAGGTAGCGAACCGGCAACCTCCGGTTCTGAAACCCCAG GTACTTCTGAAAGCGCTACTCCTGAGTCCGGCCCAGGTAGCCCGGCTGGCTCTCCGACTTCCACC GAGGAAGGTAGCCCGGCTGGCTCTCCAACTTCTACTGAAGAAGGTACTTCTACCGAACCTTCCGA GGGCAGCGCACCAGGTACTTCTGAAAGCGCTACCCCTGAGTCCGGCCCAGGTACTTCTGAAAGCG CTACTCCTGAATCCGGTCCAGGTACTTCTGAAAGCGCTACCCCGGAATCTGGCCCAGGTAGCGAA CCGGCTACTTCTGGTTCTGAAACCCCAGGTAGCGAACCGGCTACCTCCGGTTCTGAAACTCCAGG TAGCCCAGCAGGCTCTCCGACTTCCACTGAGGAAGGTACTTCTACTGAACCTTCCGAAGGCAGCG CACCAGGTACCTCTACTGAACCTTCTGAGGGCAGCGCTCCAGGTAGCGAACCTGCAACCTCTGGC TCTGAAACCCCAGGTACCTCTGAAAGCGCTACTCCTGAATCTGGCCCAGGTACTTCTACTGAACC GTCCGAGGGCAGCGCACCA | 239 |
| AE576 | GGTAGCCCGGCTGGCTCTCCTACCTCTACTGAGGAAGGTACTTCTGAAAGCGCTACTCCTGAGTC TGGTCCAGGTACCTCTACTGAACCGTCCGAAGGTAGCGCTCCAGGTAGCCCAGCAGGCTCTCCGA CTTCCACTGAGGAAGGTACTTCTACTGAACCTTCCGAAGGCAGCGCACCAGGTACCTCTACTGAA CCTTCTGAGGGCAGCGCTCCAGGTACTTCTGAAAGCGCTACCCCGGAATCTGGCCCAGGTAGCGA ACCGGCTACTTCTGGTTCTGAAACCCCAGGTAGCGAACCGGCTACCTCCGGTTCTGAAACTCCAG GTAGCCCGGCAGGCTCTCCGACCTCTACTGAGGAAGGTACTTCTGAAAGCGCAACCCCGGAGTCC GGCCCAGGTACCTCTACCGAACCGTCTGAGGGCAGCGCACCAGGTACTTCTACCGAACCGTCCGA GGGTAGCGCACCAGGTAGCCCAGCAGGTTCTCCTACCTCCACCGAGGAAGGTACTTCTACCGAAC CGTCCGAGGGTAGCGCACCAGGTACCTCTACTGAACCTTCTGAGGGCAGCGCTCCAGGTACTTCT GAAAGCGCTACCCCGGAGTCCGGTCAGGTACTTCTACTGAACCGTCCGAAGGTAGCGCACCAGG TACTTCTGAAAGCGCAACCCCTGAATCCGGTCCAGGTAGCGAACCGGCTACTTCTGGCTCTGAGA CTCCAGGTACTTCTACCGAACCGTCGAAGGTAGCGCACCAGGTAGTTCTACTGAACCGTCTGAA GGTAGCGCACCAGGTACTTCTGAAAGCGCAACCCCGGAATCGGCCCAGGTACCTCTGAAAGCGC AACCCCGGAGTCCGGCCCAGGTAGCCCTGCTGGCTCTCCAACCTCCACCGAAGAAGGTACCTCTG AAAGCGCAACCCCTGAATCCGGCCCAGGTAGCGAACCGGCAACCTCCGGTTCTGAAACCCCAGGT ACCTCTGAAAGCGCTACTCCGGAGTCTGGCCCAGGTACCTCTACTGAACCGTCTGAGGGTAGCGC TCCAGGTACTTCTACTGAACCGTCCGAAGGTAGCGCACCAGGTACTTCTACCGAACCGTCCGAAG | 240 |

TABLE 9-continued

DNA nucleotide sequences of XTEN and precursor sequences

| XTEN Name | DNA Nucleotide Sequence | SEQ ID NO: |
|---|---|---|
| | GCAGCGCTCCAGGTACCTCTACTGAACCTTCCGAGGGCAGCGCTCCAGGTACCTCTACCGAACCT<br>TCTGAAGGTAGCGCACCAGGTACTTCTACCGAACCGTCCGAGGGTAGCGCACCAGGTAGCCCAGC<br>AGGTTCTCCTACCTCCACCGAGGAAGGTACTTCTACCGAACCGTCCGAGGGTAGCGCACCAGGTA<br>CCTCTGAAAGCGCAACTCCTGAGTCTGGCCCAGGTAGCGAACCTGCTACCTCCGGCTCTGAGACT<br>CCAGGTACCTCTGAAAGCGCAACCCCGGAATCTGGTCAGGTAGCGAACCTGCAACCTCTGGCTC<br>TGAAACCCCAGGTACCTCTGAAAGCGCTACTCCTGAATCTGGCCCAGGTACTTCTACTGAACCGT<br>CCGAGGGCAGCGCACCAGGTACTTCTGAAAGCGCTACTCCTGAGTCCGGCCCAGGTAGCCCGGCT<br>GGCTCTCCGACTTCCACCGAGGAAGGTAGCCCGGCTGGCTCTCCAACTTCTACTGAAGAAGGTAG<br>CCCGGCAGGCTCTCCGACCTCTACTGAGGAAGGTACTTCTGAAAGCGCAACCCCGGAGTCCGGCC<br>CAGGTACCTCTACCGAACCGTCTGAGGGCAGCGCACCA | |
| AF576 | GGTTCTACTAGCTCTACCGCTGAATCTCCTGGCCCAGGTTCCACTAGCTCTACCGCAGAATCTCC<br>GGGCCCAGGTTCTACTAGCGAATCCCCTTCTGGTACCGCTCCAGGTTCTACTAGCTCTACCGCTG<br>AATCTCCGGGTCCAGGTTCTACCAGCTCTACTGCAGAATCTCCTGGCCCAGGTACTTCTACTCCG<br>GAAAGCGGTTCCGCTTCTCCAGGTTCTACCAGCGAATCTCCTTCTGGCACCGCTCCAGGTACCTC<br>TCCTAGCGGCGAATCTTCTACCGCTCCAGGTTCTACTAGCGAATCTCCTTCTGGCACCGCTCCAG<br>GTTCTACCAGCGAATCTCCTTCTGGCACCGCTCCAGGTACCTCTCCTAGCGGCGAATCTTCTACC<br>GCTCCAGGTTCTACTAGCGAATCTCCTTCTGGCACTGCACCAGGTTCTACCAGCGAATCTCCTTC<br>TGGCACCGCTCCAGGTACCTCTCCTAGCGGCGAATCTTCTACCGCTCCAGGTTCTACTAGCGAAT<br>CTCCTTCTGGCACTGCACCAGGTTCTACTAGCGAATCTCCTTCTGGCACTGCACCAGGTTCTACC<br>AGCGAATCTCCGTCTGGCACTGCACCAGGTACCTCTACCCCTGAAAGCGGTTCCGCTTCTCCAGG<br>TTCTACTAGCGAATCTCCTTCTGGTACCGCTCCAGGTACTTCTACCCCTGAAAGCGGTTCCGCTT<br>CTCCAGGTTCCACTAGCTCTACCGCTGAATCTCCGGGTCCAGGTTCTACTAGCTCTACTGCAGAA<br>TCTCCTGGCCCAGGTACCTCTACTCCGGAAAGCGGTCTGCATCTCCAGGTACTTCTACCCCTGA<br>AAGCGGTTCTGCATCTCCAGGTTCTACTAGCGAATCCCCGTCTGGTACCGCACCAGGTACTTCTA<br>CCCCGGAAAGCGGCTCTGCTTCTCCAGGTACTTCTACCCCGGAAAGCGGCTCCGCATCTCCAGGT<br>TCTACTAGCGAATCTCCTTCTGGTACCGCTCCAGGTTCTACCAGCGAATCCCCGTCTGGTACTGC<br>TCCAGGTTCTACCAGCGAATCTCCTTCTGGTACTGCACCAGGTTCTACTAGCTCTACTGCAGAAT<br>CTCCTGGCCCAGGTACCTCTACTCCGGAAAGCGGCTCTGCATCTCCAGGTACTTCTACCCCTGAA<br>AGCGGTTCTGCATCTCCAGGTTCTACTAGCGAATCTCCTTCTGGCACTGCACCAGGTTCTACCAG<br>CGAATCTCCGTCTGGCACTGCACCAGGTACCTCTACCCCTGAAAGCGGTTCCGCTTCTCCAGGTT<br>CTACTAGCGAATCTCCTTCTGGCACTGCACCAGGTTCTACCAGCGAATCTCCGTCTGGCACTGCA<br>CCAGGTACCTCTACCCCTGAAAGCGGTTCGCTTCTCCAGGTACTTCTCCGAGCGGTGAATCTTC<br>TACCGCACCAGGTTCTACTAGCTCTACCGCTGAATCTCCGGGCCCAGGTACTTCTCCGAGCGGTG<br>AATCTTCTACTGCTCCAGGTTCCACTAGCTCTACTGCTGAATCTCCTGGCCCAGGTACTTCTACT<br>CCGGAAAGCGGTTCCGCTTCTCCAGGTTCTACTAGCGAATCTCCGTCTGGCACCGCACCAGGTTC<br>TACTAGCTCTACTGCAGAATCTCCTGGCCCAGGTACCTCTACTCCGGAAAGCGGCTCTGCATCTC<br>CAGGTACTTCTACCCCTGAAAGCGGTTCTGCATCTCCA | 241 |
| AM875 | GGTACTTCTACTGAACCGTCTGAAGGCAGCGCACCAGGTAGCGAACCGGCTACTTCCGGTTCTGA<br>AACCCCAGGTAGCCCAGCAGGTTCTCCAACTTCTACTGAAGAAGGTTCTACCAGCTCTACCGCAG<br>AATCTCCTGGTCCAGGTACCTCTACTCCGGAAAGCGGCTCTGCATCTCCAGGTTCTACTAGCGAA<br>TCTCCTTCTGGCACTGCACCAGGTTCTACTAGCGAATCCCCGTCTGGTACTGCTCCAGGTACTTC<br>TACTCCTGAAAGCGGTTCCGCTTCTCCAGGTACCTCTACTCCGGAAAGCGGTTCTGCATCTCCAG<br>GTAGCGAACCGGCAACCTCCGGCTCTGAAACCCCAGGTACCTCTGAAAGCGCTACTCCTGAATCC<br>GGCCCAGGTAGCCCGGCAGGTTCTCCGACTTCCACTGAGGAAGGTACCTCTACTGAACCTTCTGA<br>GGGCAGCGCTCCAGGTACTTCTGAAAGCGCTACCCCGGAGTCCGGTCAGGTACTTCTACTGAAC<br>CGTCCGAAGGTAGCGCACCAGGTACTTCTACCGAACCGTCCGAGGGTAGCGCACCAGGTAGCCCA<br>GCAGGTTCTCCTACCTCCACCGAGGAAGGTACTTCTACCGAACCGTCCGAGGGTAGCGCACCAGG<br>TACTTCTACCGAACCTTCCGAGGGCAGCGCACCAGGTACTTCTGAAAGCGCTACCCCTGAGTCCG<br>GCCCAGGTACTTCTGAAAGCGCTACTCCTGAATCCGGTCCAGGTACCTCTACTGAACCTTCCGAA<br>GGCAGCGCTCCAGGTACCTCTACCGAACCGTCCGAGGGCAGCGCACCAGGTACTTCTGAAAGCGC<br>AACCCCTGAATCGGTCCAGGTACTTCTACTGAACCTTCCGAAGGTAGCGCTCCAGGTAGCGAAC<br>CTGCTACTTCTGGTTCTGAAACCCCAGGTAGCCCGGCTGGCTCTCCGACCTCCACCGAGGAAGGT<br>AGCTCTACCCCGTCTGGTGCTACTGGTTCTCCAGGTACTCCGGGCAGCGGTACTGCTTCTTCCTC<br>TCCAGGTAGCTCTACCCCTTCTGGTGCTACTGGCTCTCCAGGTACCTCTACCGAACCGTCCGAGG<br>GTAGCGCACCAGGTACCTCTACTGAACCGTCTGAGGGTAGCGCCAGGTAGCGAACCGGCAACC<br>TCCGGTTCTGAAACTCCAGGTAGCCCTGCTGGCTCTCCGACTTCTACTGAGGAAGGTAGCCCGGC<br>TGGTTCTCCGACTTCTACTGAGGAAGGTACTTCTACCGAACCTTCCGAAGGTAGCGCTCCAGGTG<br>CAAGCGCAAGCGGCGCGCCAAGCACGGGAGGTACTTCTGAAAGCGCTACTCCTGAGTCCGGCCCA<br>GGTAGCCCGGCTGGCTCTCCGACTTCCACCGAGGAAGGTAGCCCGGCTGGCTCTCCAACTTCTAC<br>TGAAGAAGGTTCTACCAGCTCTACCGCTGAATCTCCTGGCCCAGGTACCGCACCAGGTACCCCTGGCAGC<br>CTGGCACCGCACCAGGTACTTCCCTAGCGGTGAATCTTCTACTGCACCAGGTACCCCTGGCAGC<br>GGTACCGCTTCTTCCTCTCCAGGTAGCTCTACCCCGTCTGGTGCTACTGGCTCTCCAGGTTCTAG<br>CCCGTCTGCATCTACCGGTACCGGCCCAGGTAGCGAACCGGCAACCTCCGGCTCTGAAACTCCAG<br>GTACTTCTGAAAGCGCTACTCCGGAATCCGGCCCAGGTAGCGAACCGGCTACTTCCGGCTCTGAA<br>ACCCCAGGTTCCACCAGCTCTACTGCAGAATCTCCGGGCCAGGTTCTACTAGCTCTACTGCAGA<br>ATCTCCGGGTCCAGGTACTTCTCCTAGCGGCGAATCTTCTACCGCTCCAGGTAGCGAACCGGCAA<br>CCTCTGGCTCTGAAACTCCAGGTAGCGAACCTGCAACCTCCGGCTCTGAAACCCCAGGTACTTCT<br>ACTGAACTTCTGAGGGCAGCGCACCAGGTTCTACCAGCTCTACCGCAGAATCTCCTGGTCCAGG<br>TACCTCTACTCCGGAAAGCGGCTCTGCATCTCCAGGTTCTACTAGCGAATCTCCTTCTGGCACTG<br>CACCAGGTACTTCTACCGAACCGTCCGAAGCAGCGCTCCAGGTACCTCTACTGAACCTTCCGAG<br>GGCAGCGCTCCAGGTACCTCTACCGAACCTTCTGAAGGTAGCGCACCAGGTAGCTCTACTCCGTC<br>TGGTGCAACCGGCTCCCAGGTTCTAGCCCGTCTGCTTCCACTGGTACTGGCCAGGTGCTTCCC<br>CGGGCACCAGCTCTACTGGTTCTCCAGGTAGCGAACCTGCTACCTCCGGTTCTGAAACCCCAGGT | 242 |

TABLE 9-continued

DNA nucleotide sequences of XTEN and precursor sequences

| XTEN Name | DNA Nucleotide Sequence | SEQ ID NO: |
|---|---|---|
| | ACCTCTGAAAGCGCAACTCCGGAGTCTGGTCCAGGTAGCCCTGCAGGTTCTCCTACCTCCACTGA GGAAGGTAGCTCTACTCCGTCTGGTGCAACCGGCTCCCCAGGTTCTAGCCCGTCTGCTTCCACTG GTACTGGCCCAGGTGCTTCCCCGGGCACCAGCTCTACTGGTTCTCCAGGTACCTCTGAAAGCGCT ACTCCGGAGTCTGGCCCAGGTACCTCTACTGAACCGTCTGAGGGTAGCGCTCCAGGTACTTCTAC TGAACCGTCCGAAGGTAGCGCACCA | |
| AE864 | GGTAGCCCGGCTGGCTCTCCTACCTCTACTGAGGAAGGTACTTCTGAAAGCGCTACTCCTGAGTC TGGTCCAGGTACCTCTACTGAACCGTCCGAAGGTAGCGCTCCAGGTAGCCCAGCAGGCTCTCCGA CTTCCACTGAGGAAGGTACTTCTACTGAACCTTCCGAAGGCAGCGCACCAGGTACCTCTACTGAA CCTTCTGAGGGCAGCGCTCCAGGTACTTCTGAAAGCGCTACCCCGGAATCTGGCCCAGGTAGCGA ACCGGCTACTTCTGGTTCTGAAACCCCAGGTAGCGAACCGGCTACCTCCGGTTCTGAAACTCCAG GTAGCCCGGCAGGCTCTCCGACCTCTACTGAGGAAGGTACTTCTGAAAGCGCAACCCCGGAGTCC GGCCCAGGTACCTCTACCGAACCGTCTGAGGGCAGCGCACCAGGTACTTCTACCGAACCGTCCGA GGGTAGCGCACCAGGTAGCCCAGCAGGTTCTCCTACCTCCACCGAGGAAGGTACTTCTACCGAAC CGTCCGAGGGTAGCGCACCAGGTACCTCTACTGAACCTTCTGAGGGCAGCGCTCCAGGTACTTCT GAAAGCGCTACCCCGGAGTCCGGTCCAGGTACTTCTACTGAACCGTCCGAAGGTAGCGCACCAGG TACTTCTGAAAGCGCAACCCCTGAATCCGGTCCAGGTAGCGAACCGGCTACTTCTGGCTCTGAGA CTCCAGGTACTTCTACCGAACCGTCCGAAGGTAGCGCACCAGGTACTTCTACTGAACCGTCTGAA GGTAGCGCACCAGGTACTTCTGAAAGCGCAACCCCGGAATCCGGCCCAGGTACCTCTGAAAGCGC AACCCCGGAGTCGGCCCAGGTAGCCCTGCTGGCTCTCCAACCTCCACCGAAGAAGGTACTTCTG AAAGCGCAACCCCTGAATCCGGCCCAGGTAGCGAACCGGCAACCTCCGGTTCTGAAACCCCAGGT ACCTCTGAAAGCGCTACTCCGGAGTCTGGCCCAGGTACCTCTACTGAACCGTCTGAGGGTAGCGC TCCAGGTACTTCTACTGAACCGTCCGAAGGTAGCGCACCAGGTACTTCTACCGAACCGTCCGAAG GCAGCGCTCCAGGTACCTCTACTGAACCTTCCGAGGGCAGCGCTCCAGGTACCTCTACCGAACCT TCTGAAGGTAGCGCACCAGGTACTTCTACCGAACCGTCCGAGGGTAGCGCACCAGGTAGCCCAGC AGGTTCTCCTACCTCCACCGAGGAAGGTACTTCTACCGAACCGTCCGAGGGTAGCGCACCAGGTA CCTCTGAAAGCGCAACTCCTGAGTCTGCCCAGGTAGCGAACCTGCTACCTCCGGCTCTGAGACT CCAGGTACCTCTGAAAGCGCAACCCCGGAATCTGGTCCAGGTAGCGAACCTGCAACCTCTGGCTT TGAAACCCCAGGTACCTCTGAAAGCGCTACTCCTGAATCTGGCCCAGGTACTTCTACTGAACCGT CCGAGGGCAGCGCACCAGGTACTTCTGAAAGCGCTACTCCTGAGTCCGGCCCAGGTAGCCCGGCT GGCTCTCCGACTTCCACCGAGGAAGGTAGCCCGGCTGGCTCTCCAACTTCTACTGAAGAAGGTAG CCCGGCAGGCTCTCCGACCTCTACTGAGGAAGGTACTTCTGAAAGCGCAACCCCGGAGTCCGGCC CAGGTACCTCTACCGAACCGTCTGAGGGCAGCGCACCAGGTACTTCTGAAAGCGCAACTCCTGAG TCTGGCCCAGGTAGCGAACCTGCTACCTCCGGCTCTGAGACTCCAGGTACCTCTGAAAGCGCAAC CCCGGAATCTGGTCCAGGTAGCGAACCTGCAACCTCTGGCTCTGAAACCCCAGGTACCTCTGAAA GCGCTACTCCTGAATCTGGCCCAGGTACTTCTACTGAACCGTCCGAGGGCAGCGCACCAGGTAGC CCTGCTGGCTCTCCAACCTCCACCGAAGAAGGTACTCTGAAAGCGCAACCCCTGAATCCGGCC AGGTAGCGAACCGGCAACCTCCGGTTCTGAAACCCCAGGTACTTCTGAAAGCGCTACTCCTGAGT CCGGCCCAGGTAGCCCGGCTGGCTCTCCGACTTCCACCGAGGAAGGTAGCCCGGCTGGCTCTCCA ACTTCTACTGAAGAAGGTACTTCTACCGAACCTTCCGAGGGCAGCGCACCAGGTACTTCTGAAAG CGCTACCCCTGAGTCCGGCCCAGGTACTTCTGAAAGCGCTACTCCTGAATCGGTCCAGGTACTT CTGAAAGCGCTACCCCGGAATCTGGCCCAGGTAGCGAACCGGCTACTTCTGGTTCTGAAACCCCA GGTAGCGAACCGGCTACCTCCGGTTCTGAAACTCCAGGTAGCCCAGCAGGCTCTCCGACTTCCAC TGAGGAAGGTACTTCTACTGAACCTTCCGAAGGCAGCGCACCAGGTACCTCTACTGAACCTTCTG AGGGCAGCGCTCCAGGTAGCGAACCTGCAACCTCTGGCTCTGAAACCCCAGGTACCTCTGAAAGC GCTACTCCTGAATCTGGCCCAGGTACTTCTACTGAACCGTCCGAGGGCAGCGCACCA | 243 |
| AF864 | GGTTCTACCAGCGAATCTCCTTCTGGCACCGCTCCAGGTACCTCTCCTAGCGGCGAATCTTCTAC CGCTCCAGGTTCTACTAGCGAATCTCCTTCTGGCACTGCACCAGGTTCTACTAGCGAATCCCCGT CTGGTACTGCTCCAGGTTACTTCTACTCCTGAAAGCGGTTCCGCTTCTCCAGGTACCTCTACTCC GGAAAGCGGTTCTGCATCTCCAGGTTCTACCAGCGAATCTCCTTCTGGCACCGCTCCAGGTTCTA CTAGCGAATCCCGTCTGGTACCGCACCAGGTACTTCTCCTAGCGGCGAATCTTCTACCGCACCA GGTTCTACTAGCGAATCTCCGTCTGGCACTGCTCCAGGTTCTCCTAGCGGTGAATCTTCTACC CGCTCCAGGTACTTCCCCTAGCGGCGAATCTTCTACCGCTCCAGGTTCTACTAGCTCTACTGCGA AATCTCCGGGCCCAGGTACCTCTCCTAGCGGTGAATCTTCTACCGCTCCAGGTACTTCTCCGAGC GGTGAATCTTCTACCGCTCCAGGTTCTACTAGCTCTACTGCAGAATCTCCTGGCCCAGGTACCTC TACTCCGGAAAGCGGCTCTGCATCTCCAGGTACTTCTACCCCTGAAAGCGGTTCTGCATCTCCAG GTTCTACTAGCGAATCTCCTTCTGGCACTGCACCAGGTTCTACCAGCGAATCTCCGTCTGGCACT GCACCAGGTACCTCTACCCCTGAAAGCGGTTCCGCTTCTCCAGGTTCTACCAGCTCTACCGCAGA ATCTCCTGGTCCAGGTACCTCTACTCCGGAAAGCGGCTCTGCATCTCCAGGTTCTACTAGCGAAT CTCCTTCTGGCACTGCACCAGGTACTTCTCCGAGCGGTGAATCTTCTACCGCACCAGGTTCTACT AGCTCTACCGCTGAATCCCGGGCCCAGGTACTTCTCCAGGTAGTTCTACTGCTCTACCTCCGG TACCTCTACTCCTGAAAGCGGTTCTGCATCTCCAGGTTCCACTAGCTCTACCGCAGAATCTCCGG GCCCAGGTTCTACTAGCTCTACTGCTGAATCTCCTGGCCCAGGTTCTACTAGCTCTACTGCTGAA TCTCCGGGTCCAGGTTCTACCAGCTCTACTGCTGAATCTCCTGGTCCAGGTACCTCCCCGAGCGG TGAATCTTCTACTGCTCCACCAGGTTCTACTAGCGAATCTCCTTCTGGCACTGCACCAGGTTACCA GCGAATCTCCGTCTGGCACTGCACCAGGTACCTCTACCCCTGAAAGCGGTCCXXXXXXXXXXXT GCAAGCGCAAGCGGCGCGCCAAGCACGGGAXXXXXXXXXTAGCGAATCTCCTTCTGGTACCGCTCC AGGTTCTACCAGCGAATCCCCGTCTGGTACTGCTCCAGGTTCTACCAGCGAATCTCCTTCTGGTA CTGCACCAGGTTCTACTAGCGAATCCTTCTGGTACCGCTCCAGGTTCTACCAGCGAATCCCCG TCTGGTACTGCTCCAGGTTCTACCAGCGAATCTCCTTCTGGTACTGCACCAGGTACTTCTACTCC GGAAAGCGGTTCCGCATCTCCAGGTACTTCTCCTAGCGGTGAATCTTCTACTGCTCCAGGTACCT CTCCTAGCGGCGAATCTTCTACTGCTCCAGGTTCTACCAGCTCTACTGCTGAATCTCCGGGTCCA GGTACTTCCCCGAGCGGTGAATCTTCTACTGCACCAGGTACTTCTACTCCGGAAAGCGGTTCCGC TTCTCCAGGTTCTACCAGCGAATCTCCTTCTGGCACCGCTCCAGGTTCTACTAGCGAATCCCCGT | 244 |

TABLE 9-continued

DNA nucleotide sequences of XTEN and precursor sequences

| XTEN Name | DNA Nucleotide Sequence | SEQ ID NO: |
|---|---|---|
| | CTGGTACCGCACCAGGTACTTCTCCTAGCGGCGAATCTTCTACCGCACCAGGTTCTACTAGCGAA TCCCCGTCTGGTACCGCACCAGGTACTTCTACCCCGGAAAGCGGCTCTGCTTCTCCAGGTACTTC TACCCCGGAAAGCGGCTCCGCATCTCCAGGTTCTACTAGCGAATCTCCTTCTGGTACCGCTCCAG GTACTTCTACCCCTGAAAGCGGCTCCGCTTCTCCAGGTTCCACTAGCTCTACCGCTGAATCTCCG GGTCCAGGTTCTACCAGCGAATCTCCTTCTGGCACCGCTCCAGGTTCTACTAGCGAATCCCCGTC TGGTACCGCACCAGGTACTTCTCCTAGCGGCGAATCTTCTACCGCACCAGGTTCTACCAGCTCTA CTGCTGAATCTCCGGGTCCAGGTACTTCCCCGAGCGGTGAATCTTCTACTGCACCAGGTACTTCT ACTCCGGAAAGCGGTTCCGCTTCTCCAGGTACCTCCCCTAGCGGCGAATCTTCTACCGCTCCAGG TACCTCTCCTAGCGGCGAATCTTCTACCGCTCAGGTACCTCCCCTAGCGGTGAATCTTCTACCG CACCAGGTTCTACTAGCTCTACTGCTGAATCTCCGGGTCCAGGTTCTACCAGCTCTACTGCTGAA TCTCCTGGTCCAGGTACCTCCCCGAGCGGTGAATCTTCTACTGCACCAGGTTCTAGCCCTTCTGC TTCCACCGGTACCGGCCCAGGTAGCTCTACTCCGTCTGGTGCAACTGGCTCTCCAGGTAGCTCTA CTCCGTCTGGTGCAACCGGCTCCCCA XXXX was inserted in two areas where no sequence information is available. | |
| AG864 | GGTGCTTCCCCGGGCACCAGCTCTACTGGTTCTCCAGGTTCTAGCCCGTCTGCTTCTACTGGTAC TGGTCCAGGTTCTAGCCCTTCTGCTTCCACTGGTACTGGTCCAGGTACCCCGGGTAGCGGTACCG CTTCTTCTTCTCCAGGTAGCTCTACTCCGTCTGGTGCTACCGGCTCTCCAGGTTCTAACCCTTCT GCATCCACCGGTACCGGCCAGGTGCTTCTCCAGGTACCAGCTCTACTGGTTCTCCAGGTACCCC GGGCAGCGGTACCGCATCTTCTTCTCCAGGTAGCTCTACTCCTTCTGGTGCAACTGGTTCTCCAG GTACTCCTGGCAGCGGTACCGCTTCTTCTTCTCCAGGTGCTTCTCCTGGTACTAGCTCTACTGGT TCTCCAGGTGCTTCTCCGGGCACTAGCTCTACTGGTTCTCCAGGTACCCCGGGTAGCGGTACTGC TTCTTCCTCTCCAGGTAGCTCTACCCCTTCTGGTGCAACCGGCTCTCCAGGTGCTTCTCCGGGCA CCAGCTCTACCGGTTCTCCAGGTACCCCGGGTAGCGGTACCGCTTCTTCTTCTCCAGGTAGCTCT ACTCCGTCTGGTGCTACCGGCTCTCCAGGTTCTAACCCTTCTGCATCCACCGGTACCGGCCCAGG TTCTAGCCCTTCTGCTTCCACCGGTACTGGCCCAGGTAGCTCTACCCCTTCTGGTGCTACCGGCT CCCCAGGTAGCTCTACTCCTTCTGGTGCAACTGGCTCTCCAGGTGCATCTCCGGGCACTAGCTCT ACTGGTTCTCCAGGTGCATCCCCTGGCACTAGCTCTACTGGTTCTCCAGGTGCTTCTCCTGGTAC CAGCTCTACTGGTTCTCCAGGTACTCCTGGCAGCGGTACCGCTTCTTCTTCTCCAGGTGCTTCTC CTGGTACTAGCTCTACTGGTTCTCCAGGTGCTTCTCCGGGCACTAGCTCTACTGGTTCTCCAGGT GCTTCCCGGGCACTAGCTCTACCGGTTCTCCAGGTTCTAGCCCTTCTGCATCTACTGGTACTGG CCCAGGTACTCCGGGCAGCGGTACTGCTTCTTCCTCTCCAGGTGCATCTCCGGGCACTAGCTCTA CTGGTTCTCCAGGTGCATCCCCTGGCACTAGCTCTACTGGTTCTCCAGGTGCTTCTCCTGGTACC AGCTCTACTGGTTCTCCAGGTAGCTCTACTCCGTCTGGTGCAACCGGTTCCCCAGGTAGCTCTAC TCCTTCTGGTGCTACTGGCTCCCCAGGTGCATCCCCTGGCACCAGCTCTACCGGTTCTCCAGGTA CCCGGGCAGCGGTACCGCATCTTCCTCTCCAGGTAGCTCTACCCCGTCTGGTGCTACCGGTTCC CCAGGTAGCTCTACTCCCCGTCTGGTGCAACCGGCTCCCCAGGTAGCTCTACTCCGTCTGGTGCAAC CGGCTCCCCAGGTTCTAGCCCGTCTGCTTCCACTGGTACTGGCCCAGGTGCTTCCCCGGGCACCA GCTCTACTGGTTCTCCAGGTGCATCCCCGGGTACCAGCTCTACCGGTTCTCCAGGTACTCCTGGC AGCGGTACTGCATCTTCCTCTCCAGGTGCTTCTCCAGGTACCAGCTCTACTGGTTCTCCAGGTGC ATCTCCGGGCACTAGCTCTACTGGTTCTCCAGGTGCATCCCCTGGCACTAGCTCTACTGGTTCTC CAGGTGCTTCTCCTGGTACCAGCTCTACTGGTTCTCCAGGTACCCCTGGTAGCGGTACTGCTTCT TCCTCTCCAGGTAGCTCTACTCCGTCTGGTGCTACCGGTTCTCCAGGTACCCCGGGTAGCGGTAC CGCATCTTCTTCTCCAGGTAGCTCTACCCCGTCTGGTGCTACTGGTTCTCCAGGTACTCCGGGCA GCGGTACTGCTTCTTCCTCTCCAGGTAGCTCTACCCCTTCTGGTGCTACTGGCTCTCCAGGTAGC TCTACCCGTCTGGTGCTACTGGCTCCCCAGGTTCTAGCCCTTCTGCATCCACCGGTACCGGTCC AGGTTCTAGCCCGTCTGCATCTACTGGTACTGGTCCAGGTGCATCCCCGGGCACTAGCTCTACCG GTTCTCCAGGTACTCCTGGTAGCGGTACTGCTTCTTCTTCTCCAGGTAGCTCTACTCCTTCTGGT GCTACTGGTTCTCCAGGTTCTAGCCCTTCTGCATCCACCGGTACCGGCCCAGGTTCTAGCCCGTC TGCTTCTACCGGTACTGGTCCAGGTGCTTCTCGGGTACTAGCTCTACTGGTTCTCCAGGTGCAT CTCCTGGTACTAGCTCTACTGGTTCTCCAGGTAGCTCTACTCCGTCTGGTGCAACCGGCTCTCCA GGTTCTAGCCCTTCTGCATCTACCGGTACTGGTCAGGTGCCCCCTGGTACCAGCTCTACCGG TTCTCCAGGTTCTAGCCCTTCTGCTTCTACCGGTACCGGTCCAGGTACCCCTGGCAGCGGTACCG CATCTTCCTCTCCAGGTAGCTCTACTCCGTCTGGTGCAACCGGTTCCCCAGGTAGCTCTACTCCT TCTGGTGCTACTGGCTCCCCAGGTGCATCCCCTGGCACCAGCTCTACCGGTTCTCCA | 245 |
| AM923 | ATGGCTGAACCTGCTGGCTCTCCAACCTCCACTGAGGAAGGTGCATCCCCGGGCACCAGCTCTAC CGGTTCTCCAGGTAGCTCTACCCCGTCTGGTGCTACCGGCTCTCCAGGTAGCTCTACCCCGTCTG GTGCTACTGGCTCTCCAGGTACTTCTACTGAACCGTCTGAAGGCAGCGCACCAGGTAGCGAACCG GCTACTTCCGGTTCTGAAACCCCAGGTAGCCCAGCAGGTTCTCCAACTTCTACTGAAGAAGGTTC TACCAGCTCTACCGCAGAATCTCCTGGTCCAGGTACCTCTACTCCGGAAAGCGGCTCTGCATCTC CAGGTTCTACTAGCGAATCTCCTTCTGGCACTGCACCAGGTTCTACTAGCGAATCCCCGTCTGGT ACTGCTCCAGGTACTTCTACTCCTGAAAGCGGTTCCGCTTCTCCAGGTACCTCTACTCCGGAAAG CGGTTCTGCATCTCCAGGTAGCGAACCGGCAACCTCCGGCTCTGAAACCCCAGGTACCTCTGAAA GCGCTACTCCTGAATCCGGCCCAGGTAGCCGGCAGGTTCTCCGACTTCTACTGAGGAAGGTACC TCTACTGAACTTCTGAGGGCAGCGCTCCAGGTACTTCTGAAAGCGCTACCCCGGAGTCCGGTCC AGGTACTTCTACTGAACCGTCCGAAGGTAGCGCACCAGGTACTTCTACCGAACCGTCCGAGGGTA GCGCACCAGGTAGCCCAGCAGGTTCTCCTACCTCCACCGAGGAAGGTACTTCTACCGAACCGTCC GAGGGTAGCGCACCAGGTACTTCTACCGAACCTTCCGAGGGCAGCGCACCAGGTACTTCTGAAAG CGCTACCCCTGAGTCCGGCCCAGGTACTTCTGAAAGCGCTACTGCTGAATCCGGTCCAGGTACCT CTACTGAACCTTCCGAAGGCAGCGCTCCAGGTACCTCTACCGAACCGTCCGAGGGCAGCGCACCA GGTACTTCTGAAAGCGCAACCCCTGAATCCGGTCCAGGTACTTCTACTGAACCTTCCGAAGGTAG CGCTCCAGGTAGCGAACCTGCTACTTCTGGTTCTGAAACCCCAGGTAGCCCGGCTGGCTCTCCGA CCTCCACCGAGGAAGGTAGCTCTACCCCGTCTGGTGCTACTGGTTCTCCAGGTACTCCGGGCAGC | 246 |

TABLE 9-continued

DNA nucleotide sequences of XTEN and precursor sequences

| XTEN Name | DNA Nucleotide Sequence | SEQ ID NO: |
|---|---|---|
| | GGTACTGCTTCTTCCTCTCCAGGTAGCTCTACCCCTTCTGGTGCTACTGGCTCTCCAGGTACCTC TACCGAACCGTCCGAGGGTAGCGCACCAGGTACCTCTACTGAACCGTCTGAGGGTAGCGCTCCAG GTAGCGAACCGGCAACCTCCGGTTCTGAAACTCCAGGTAGCCCTGCTGGCTCTCCAGACTTCTACT GAGGAAGGTAGCCCCGGCTGGTTCTCCGACTTCTACTGAGGAAGGTACTTCTACCGAACCTTCCGA AGGTAGCGCTCCAGGTGCAAGCGCAAGCGGCGCGCCAAGCACGGGAGGTACTTCTGAAAGCGCTA CTCCTGAGTCCGGCCCAGGTAGCCCGGCTGGCTCTCCGACTTCCACCGAGGAAGGTAGCCCGGCT GGCTCTCCAACTTCTACTGAAGAAGGTTCTACCAGCTCTACCGCTGAATCTCCTGGCCCAGGTTC TACTAGCGAATCTCCGTCTGGCACCGCACCAGGTACTTCCCCTAGCGGTGAATCTTCTACTGCAC CAGGTACCCCTGGCAGCGGTACCGCTTCTTCCTCTCCAGGTAGCTCTACCCCGTCTGGTGCTACT GGCTCTCCAGGTTCTAGCCCGTCTGCATCTACCGGTACCGGCCCAGGTAGCGAACCGGCAACCTC CGGCTCTGAAACTCCAGGTACTTCTGAAAGCGCTACTCCGGAATCCGGCCCAGGTAGCGAACCGG CTACTTCCGGCTCTGAAACCCCAGGTTCCACCAGCTCTACTGCAGAATCTCCGGGCCCAGGTTCT ACTAGCTCTACTGCAGAATCTCCGGGTCCAGGTACTTCTCCTAGCGGCGAATCTTCTACCGCTCC AGGTAGCGAACCGGCAACCTCTGGCTCTGAAACTCAGGTAGCGAACCTGCAACCTCCGGCTCTG AAACCCCAGGTACTTCTACTGAACCTTCTGAGGGCAGCGCACCAGGTTCTACCAGCTCTACCGCA GAATCTCCTGGTCCAGGTACCTCTACTCCGGAAAGCGGCTCTGCATCTCCAGGTTCTACTAGCGA ATCTCCTTCTGGCACTGCACCAGGTACTTCTACCGAACCGTCCGAAGGCAGCGCTCCAGGTACCT CTACTGAACCTTCCGAGGGCAGCGCTCCAGGTACCTCTACCGAACCTTCTGAAGGTAGCGCACCA GGTAGCTCTACTCCGTCTGGTGCAACCGGCTCCCCAGGTTCTAGCCCGTCTGCTTCCACTGGTAC TGGCCCAGGTGCTTCCCCGGGCACCAGCTCTACTGGTTCTCCAGGTAGCGAACCTGCTACCTCCG GTTCTGAAACCCCAGGTACCTCTGAAAGCGCAACTCCGGAGTCTGGTCCAGGTAGCCCTGCAGGT TCTCCTACCTCCACTGAGGAAGGTAGCTCTACTCCGTCTGGTGCAACCGGCTCCCCAGGTTCTAG CCCGTCTGCTTCCACTGGTACTGGCCCAGGTGCTTCCCCGGGCACCAGCTCTACTGGTTCTCCAG GTACCTCTGAAAGCGCTACTCCGGAGTCTGGCCCAGGTACCTCTACTGAACCGTCTGAGGGTAGC GCTCCAGGTACTTCTACTGAACCGTCCGAAGGTAGCGCACCA | |
| AE912 | ATGGCTGAACCTGCTGGCTCTCCAACCTCCACTGAGGAAGGTACCCCGGGTAGCGGTACTGCTTC TTCCTCTCCAGGTAGCTCTACCCCTTCTGGTGCAACCGGCTCTCCAGGTGCTTCTCCGGGCACCA GCTCTACCGGTTCTCCAGGTAGCCCGGCTGGCTCTCCACCTCTACTGAGGAAGGTACTTCTGAA AGCGCTACTCCTGAGTCTGGTCAGGTACCTCTACTGAACCGTCCGAAGGTAGCGCTCCAGGTAG CCCAGCAGGCTCTCCGACTTCCACTGAGGAAGGTACTTCTACTGAACCTTCCGAAGGCAGCGCAC CAGGTACCTCTACTGAACCTTCTGAGGGCAGCGCTCCAGGTACTTCTGAAAGCGCTACCCCGGAA TCTGGCCCAGGTAGCGAACCGGCTACTTCTGGTTCTGAAACCCCAGGTAGCGAACCGGCTACCTC CGGTTCTGAAACTCCAGGTAGCCCGGCAGGCTCTCCGACCTCTACTGAGGAAGGTACTTCTGAAA GCGCAACCCCGGAGTCCGGCCCAGGTACCTCTACCGAACCGTCTGAGGGCAGCGCACCAGGTACT TCTACCGAACCGTCCGAGGGTAGCGCACCAGGTAGCCCAGCAGGTTCTCCTACCTCCACCGAGGA AGGTACTTCTACCGAACCGTCGAGGGTAGCGCACCAGGTACCTCTACTGAACCTTCTGAGGGCA GCGCTCCAGGTACTTCTGAAAGCGCTACCCCGGAGTCCGGTCCAGGTACTTCTACTGAACCGTCC GAAGGTAGCGCACCAGGTACTTCTGAAAGCGCAACCCCTGAATCCGGTCCAGGTAGCGAACCGGC TACTTCTGGCTCTGAGACTCCAGGTACTTCTACCGAACCGTCCGAAGGTAGCGCACCAGGTACTT CTACTGAACCGTCTGAAGGTAGCGCACCAGGTACTTCTGAAAGCGCACCCCGGAATCCGGTCCCA GGTACCTCTGAAAGCGCAACCCCGGAGTCCGGCCCAGGTAGCCCTGCTGGCTCTCCAACCTCCAC CGAAGAAGGTACCTCTGAAAGCGCAACCCCTGAATCCGGCCCAGGTAGCGAACCGGCAACCTCCG GTTCTGAAACCCCAGGTACCTCTGAAAGCGCTACTCCGGAGTCTGGCCCAGGTACCTCTACTGAA CCGTCTGAGGGTAGCGCTCCAGGTACTTCTACTGAACCGTCCGAAGGTAGCGCACCAGGTACTTC TACCGAACCGTCCGAAGGCAGCGCTCCAGGTACCTCTACTGAACCTTCCGAGGGCAGCGCTCCAG GTACCTCTACCGAACCTTCTGAAGGTAGCGCACCAGGTACTTCTACCGAACCGTCCGAGGGTAGC GCACCAGGTAGCCCAGCAGGTTCTCCTACCTCCACCGAGGAAGGTACTTCTACCGAACCGTCCGA GGGTAGCGCACCAGGTACCTCTGAAAGCGCAACTCCTGAGTCTGGCCCAGGTAGCGAACCTGCTA CCTCCGGCTCTGAGACTCCAGGTACCTCTGAAAGCGCAACCCCGGAATCTGGTCCAGGTAGCGAA CCTGCAACCTCTGGCTCTGAAACCCAGGTACCTCTGAAAGCGCTACTCCTGAATCTGGCCCAGG TACTTCTACTGAACCGTCCGAGGGCAGCGCACCAGGTACTTCTGAAAGCGCTACTCCTGAGTCCG GCCCAGGTAGCCCGGCTGGCTCTCCGACTTCCACCGAGGAAGGTAGCCCGGCTGGCTCTCCAACT TCTACTGAAGAAGGTAGCCCGGCAGGCTCTCCGACCTCTACTGAGGAAGGTACTTCTGAAAGCGC AACCCCGGAGTCCGGCCCAGGTACCTCTACCGAACCGTCTGAGGGCAGCGCACCAGGTACCTCTG AAAGCGCAACTCCGAGTCTGGCCCAGGTAGCGAACCTGCTACCTCCGGCTCTGAGACTCCAGGT ACCTCTGAAAGCGCAACCCCGGAATCTGGTCCAGGTAGCGAACCTGCAACCTCTGGCTCTGAAAC CCCAGGTACCTCTGAAAGCGCTACTCCTGAATCTGGCCCAGGTACTTCTACTGAACCGTCCGAGG GCAGCGCACCAGGTAGCCCTGCTGGCTCTCCAACCTCCACCGAAGAAGGTACCTCTGAAAGCGCA ACCCCTGAATCCGGCCCAGGTAGCGAACCGGCAACCTCCGGTTCTGAAACCCCAGGTACTTCTGA AAGCGCTACTCCTGAGTCCGGCCCAGGTAGCCCGGCTGGCTCTCCGACTTCCACCGAGGAAGGTA GCCCGGCTGGCTCTCCAACTTCTACTGAAGAAGGTACTTCTACCGAACCTTCCGAGGGCAGCGCA CCAGGTACTTCTGAAAGCGCTACCCCTGAGTCCGGCCCAGGTACTTCTGAAAGCGCTACTCCTGA ATCCGGTCCAGGTACTTCTGAAAGCGCTACCCCGGAATCTGGCCCAGGTAGCGAACCGGCTACTT CTGGTTCTGAAACCCAGGTAGCGAACCGGCTACCTCCGGTTCTGAAACTCCAGGTAGCCCAGCA GGCTCTCCGACTTCCACTGAGGAAGGTACTTCTACTGAACCTTCCGAAGGCAGCGCACCAGGTGC CTCTACTGAACCTTCTGAGGGCAGCGCTCCAGGTAGCGAACCTGCAACCTCTGGCTCTGAAACCC AGGTACCTCTGAAAGCGCTACTCCTGAATCTGGCCCAGGTACTTCTACTGAACCGTCCGAGGGC AGCGCACCA | 247 |
| AM1318 | GGTACTTCTACTGAACCGTCTGAAGGCAGCGCACCAGGTAGCGAACCGGCTACTTCCGGTTCTGA AACCCCAGGTAGCCCAGCAGGTTCTCCAACTTCTACTGAAGAAGGTTCTACCAGCTCTACCGCA AATCTCCTGGTCCAGGTACCTCTACTCCGGAAAGCGGCTCTGCATCTCCAGGTTCTACTAGCGAA TCTCCTTCTGGCACTGCACCAGGTTCTACTAGCGAATCCCGTCTGGTACTGCTCCAGGTACTTC TACTCCTGAAAGCGGTTCCGCTTCTCCAGGTACCTCTACTCCGGAAAGCGGTTCTGCATCTCCAG | 248 |

TABLE 9-continued

DNA nucleotide sequences of XTEN and precursor sequences

| XTEN Name | DNA Nucleotide Sequence | SEQ ID NO: |
|---|---|---|
| | GTAGCGAACCGGCAACCTCCGGCTCTGAAACCCCAGGTACCTCTGAAAGCGCTACTCCTGAATCC<br>GGCCCAGGTAGCCCGGCAGGTTCTCCGACTTCCACTGAGGAAGGTACCTCTACTGAACCTTCTGA<br>GGGCAGCGCTCCAGGTACTTCTGAAAGCGCTACCCCGGAGTCCGGTCCAGGTACTTCTACTGAAC<br>CGTCCGAAGGTAGCGCACCAGGTACTTCTACCGAACCGTCCGAGGGTAGCGCACCAGGTAGCCCA<br>GCAGGTTCTCCTACCTCCACCGAGGAAGGTACTTCTACCGAACCGTCCGAGGGTAGCGCACCAGG<br>TACTTCTACCGAACCTTCCGAGGGCAGCGCACCAGGTACTTCTGAAAGCGCTACCCCTGAGTCCG<br>GCCCAGGTACTTCTGAAAGCGCTACTCCTGAATCCGGTCCAGGTACCTCTACTGAACCTTCCGAA<br>GGCAGCGCTCCAGGTACCTCTACCGAACCGTCCGAGGGCAGCGCACCAGGTACTTCTGAAAGCGC<br>AACCCCTGAATCCGGTCCAGGTACTTCTACTGAACCTTCCGAAGGTAGCGCTCCAGGTAGCGAAC<br>CTGCTACTTCTGGTTCTGAAACCCCAGGTAGCCCGGCTGGCTCTCCGACCTCCACCGAGGAAGGT<br>AGCTCTACCCCGTCTGGTGCTACTGGTTCTCCAGGTACTCCGGGCAGCGGTACTGCTTCTTCCTC<br>TCCAGGTAGCTCTACCCCTTCTGGTGCTACTGGCTCTCCAGGTACCTCTACCGAACCGTCCGAGG<br>GTAGCGCACCAGGTACCTCTACTGAACCGTCTGAGGGTAGCGCTCCAGGTAGCGAACCGGCAACC<br>TCCGGTTCTGAAACTCCAGGTAGCCCTGCTGGCTCTCCGACTTCTACTGAGGAAGGTAGCCCGGC<br>TGGTTCTCCGACTTCTACTGAGGAAGGTACTTCTACCGAACCTTCCGAAGGTAGCGCTCCAGGTC<br>CAGAACCAACGGGGCCGGCCCCAAGCGGAGGTAGCGAACCGGCAACCTCCGGCTCTGAAACCCCA<br>GGTACCTCTGAAAGCGCTACTCCTGAATCCGGCCCAGGTAGCCCGGCAGGTTCTCCGACTTCCAC<br>TGAGGAAGGTACTTCTGAAAGCGCTACTCCTGAGTCCGGCCCAGGTAGCCCGGCTGGCTCTCCGA<br>CTTCCACCGAGGAAGGTAGCCCGGCTGGCTCTCCAACTTCTACTGAAGAAGGTACTTCTGAAAGC<br>GCTACTCCTGAGTCCGGCCCAGGTAGCCCGGCTGGCTCTCCACCGAGGAAGGTAGCCC<br>GGCTGGCTCTCCAACTTCTACTGAAGAAGGTTCTACCAGCTCTACCGCTGAATCTCCTGGCCCAG<br>GTTCTACTAGCGAATCTCCGTCTGGCACCGCACCAGGTACTTCCCTAGCGGTGAATCTTCTACT<br>GCACCAGGTTCTACCAGCGAATCTCCTTCTGGCACCGCTCCAGGTTCTACTAGCGAATCCCCGTC<br>TGGTACCGCACCAGGTACTTCTCCTAGCGGCGAATCTTCTACGCACCAGGTACTTCTACCGAAC<br>CTTCCGAGGGCAGCGCACCAGGTACTTCTGAAAGCGCTACCCCTGAGTCCGGCCCAGGTACTTCT<br>GAAAGCGCTACTCCTGAATCCGGTCCAGGTAGCGAACCGGCAACCTCTGGCTCTGAAACCCCAGG<br>TACCTCTGAAAGCGCTACTCCGGAATCTGGTCCAGGTACTTCTGAAAGCGCTACTCCGGAATCCG<br>GTCCAGGTACCTCTACTGAACCTTCTGAGGGCAGCGCTCCAGGTACTTCTGAAAGCGCTACCCCG<br>GAGTCCGGTCCAGGTACTTCTACTGAACCGTCCGAAGGTAGCGCACCAGGTACCTCCCCTAGCGG<br>CGAATCTTCTACTGCTCAGGTACCTCTCCTAGCGGCGAATCTTCTACCGCTCCAGGTACCTCCC<br>CTAGCGGTGAATCTTCTACCGCACCAGGTACTTCTACCGAACCGTCCGAGGGTAGCGCACCAGGT<br>AGCCCAGCAGGTTCTCCTACCTCCACCGAGGAAGGTACTTCTACCGAACCGTCCGAGGGTAGCGC<br>ACCAGGTTCTAGCCCTTCTGCTTCCACCGGTACCGGCCCAGGTAGCTCTACCCGTCTGGTGCAA<br>CTGGCTCTCCAGGTAGCTCTACTCCGTCTGGTGCAACCGGCTCCCAGGTAGCTCTACCCCGTCT<br>GGTGCTACCGGCTCTCCAGGTAGCTCTACCCCGTCTGGTGCAACCGGCTCCCAGGTGCATCCCC<br>GGGTACTAGCTCTACCGGTTCTCCAGGTGCAAGCGCAAGCGGCGCGCCAAGCACGGGAGGTACTT<br>CTCCGAGCGGTGAATCTTCTACCGCACCAGGTTCTACTAGCTCTACCGCTGAATCTCCTGGCCA<br>GGTACTTCTCCGAGCGGTGAATCTTCTACTGCTCCAGGTACCTCTGAAAGCGCTACTCCGGAGTC<br>TGGCCCAGGTACCTCTACTGAACCGTCTGAGGGTAGCGCTCCAGGTACTTCTACTGAACCGTCCG<br>AAGGTAGCGCACCAGGTTCTAGCCCTTCTGCATCTACTGGTACTGGCCCAGGTAGCTCTACTCCT<br>TCTGGTGCTACCGGCTCTCCAGGTGCTTCTCCAGGTACTTCTCCAGGTACTTC<br>TACTCCGGAAAGCGGTTCCGCATCTCCAGGTACTTCTCCTAGCGGTGAATCTTCTACTGCTCCAG<br>GTACCTCTCCTAGCGGCGAATCTTCTACTGCTCCAGGTACTTCTGAAAGCGCAACCCCTGAATCC<br>GGTCCAGGTAGCGAACCGGCTACTTCTGGCTCTGAGACTCCAGGTACTTCTACCGAACCGTCCGA<br>AGGTAGCGCACCAGGTTCTACCAGCGAATCCCCTTCTGGTACTGCTCCAGGTTCTACCAGCGAAT<br>CCCCTTCTGGCACCGCACCAGGTACTTCTACCCCTGAAAGCGGCTCCGCTTCTCCAGGTAGCCCG<br>GCAGGCTCTCCGACCTCTACTGAGGAAGGTACTTCTGAAAGCGCAACCCCGGAGTCCGGCCCAGG<br>TACCTCTACCGAACCGTCTGAGGGCAGCGCACCAGGTAGCCCTGCTGGCTCTCCAACCTCCACCG<br>AAGAAGGTACCTCTGAAAGCGCAACCCCTGAATCCGGCCCAGGTAGCGAACCGGCAACCTCCGGT<br>TCTGAAACCCCAGGTAGCTCTACCCCGTCTGGTGCTACCGGTTCCCCAGGTGCTTCTCCTGGTAC<br>TAGCTCTACCGGTTCTCCAGGTAGCTCTACCCCGTCTGGTGCTACTGGCTCTCCAGGTTCTACTA<br>GCGAATCCCCGTCTGGTACTGCTCCAGGTACTTCCCCTAGCGGTGAATCTTCTACTGCTCCAGGT<br>TCTACCAGCTCTACCGCAGAATCTCCGGGTCCAGGTAGCTCTACCCCTTCTGGTGCAACCGGCTC<br>TCCAGGTGCATCCCCGGGTACCAGCTCTACCGGTTCTCCAGGTACTCCGGGTAGCGGTACCGCTT<br>CTTCCTCTCCAGGTAGCCCTGCTGGCTCTCCGACTTCTACTGAGGAAGGTAGCCCGGCTGGTTCT<br>CCGACTTCTACTGAGGAAGGTACTTCTACCGAACCTTCCGAAGGTAGCGCTCCA | |
| BC864 | GGTACTTCCACCGAACCATCCGAACCAGGTAGCGCAGGTACTTCCACCGAACCATCCGAACCTGG<br>CAGCGCAGGTAGCGAACCGGCAACCTCTGGTACTGAACCATCAGGTAGCGGCGCATCCGAGCCTA<br>CCTCTACTGAACCAGGTAGCGAACCGGCTACCTCCGGTACTGAGCCATCAGGTAGCGAACCGGCA<br>ACTTCCGGTACTGAACCATCAGGTAGCGAACCGGCAACTTCCGGCACTGAACCATCAGGTAGCGG<br>TGCATCTGAGCCGACCTCTACTGAACCAGGTACTTCTACTGAACCATCTGAGCCGGGCAGCGCAG<br>GTAGCGAACCAGCTACTTCTGGCACTGAACCATCAGGTACTTCTACTGAACCATCCGAACCAGGT<br>AGCGCAGGTAGCGAACCTGCTACCTCTGGTACTGAGCCATCAGGTAGCGAACCGGCTACCTCTGG<br>TACTGAACCATCAGGTACTTCTACCGAACCATCCGAGCCTGGTAGCGCAGGTACTTCTACCGAAC<br>CATCCGAGCCAGGCAGCGCAGGTAGCGAACCGGCAACCTCTGGCACTGAGCCATCAGGTAGCGAA<br>CCAGCAACTTCTGGTACTGAACCATCAGGTACTAGCGAGCCATCTACTTCCGAACCAGGTGCAGG<br>TAGCGGCGCATCCGAACCTACTTCCACTGAACCAGGTACTAGCGAGCCATCCACCTCTGAACCAG<br>GTGCAGGTAGCGAACCGGCAACTTCCGCACTGAACCATCAGGTAGCGAACCGGCTACCTCTGGT<br>ACTGAACCATCAGGTACTTCTACCGAACCATCCGGTACTTCTACCGAACC<br>ATCCGAGCCAGGCAGCGCAGGTAGCGGTGCATCCGAGCCGACCTCTACTGAACCAGGTAGCGAAC<br>CAGCAACTTCTGGCACTGAGCCATCAGGTAGCGAACCAGCTACCTCTGGTACTGAACCATCAGGT<br>AGCGAACCGGCTACTTCCGGCACTGAACCATCAGGTAGCGAACCAGCAACCTCCGGTACTGAACC<br>ATCAGGTACTTCCACTGAACCATCCGAACCGGGTAGCGCAGGTAGCGAACCGGCAACTTCCGGCA<br>CTGAACCATCAGGTAGCGGTGCATCTGAGCCGACCTCTACTGAACCAGGTACTTCTACTGAACCA | 249 |

TABLE 9-continued

DNA nucleotide sequences of XTEN and precursor sequences

| XTEN Name | DNA Nucleotide Sequence | SEQ ID NO: |
|---|---|---|
| | TCTGAGCCGGGCAGCGCAGGTAGCGAACCTGCAACCTCCGGCACTGAGCCATCAGGTAGCGGCGC<br>ATCTGAACCAACCTCTACTGAACCAGGTACTTCCACCGAACCATCTGAGCCAGGCAGCGCAGGTA<br>GCGGCGCATCTGAACCAACCTCTACTGAACCAGGTAGCGAACCAGCAACTTCTGGTACTGAACCA<br>TCAGGTAGCGGCGCATCTGAGCCTACTTCCACTGAACCAGGTAGCGAACCGGCAACTTCCGGCAC<br>TGAACCATCAGGTAGCGGTGCATCTGAGCCGACCTCTACTGAACCAGGTACTTCTACTGAACCAT<br>CTGAGCCGGGCAGCGCAGGTAGCGAACCGGCAACTTCCGGCACTGAACCATCAGGTAGCGGTGCA<br>TCTGAGCCGACCTCTACTGAACCAGGTACTTCTACTGAACCATCTGAGCCGGGCAGCGCAGGTAG<br>CGAACCAGCTACTTCTGGCACTGAACCATCAGGTACTTCTACTGAACCATCCGAACCAGGTAGCG<br>CAGGTAGCGAACCTGCTACCTCTGGTACTGAGCCATCAGGTACTTCTACTGAACCATCCGAGCCG<br>GGTAGCGCAGGTACTTCCACTGAACCATCTGAACCTGGTAGCGCAGGTACTTCCACTGAACCATC<br>CGAACCAGGTAGCGCAGGTACTTCTACTGAACCATCCGAGCCGGGTAGCGCAGGTACTTCCACTG<br>AACCATCTGAACCTGGTAGCGCAGGTACTTCCACTGAACCATCCGAACCAGGTAGCGCAGGTACT<br>AGCGAACCATCCACCTCCGAACCAGGCGCAGGTAGCGGTGCATCTGAACCGACTTCTACTGAACC<br>AGGTACTTCCACTGAACCATCTGAGCCAGGTAGCGCAGGTACTTCCACCGAACCATCCGAACCAG<br>GTAGCGCAGGTACTTCCACCGAACCATCCGAACCTGGCAGCGCAGGTAGCGAACCGGCAACCTCT<br>GGTACTGAACCATCAGGTAGCGGTGCATCCGAGCCGACCTCTACTGAACCAGGTAGCGAACCAGC<br>AACTTCTGGCACTGAGCCATCAGGTAGCGAACCAGCTACCTCTGGTACTGAACCATCAGGTAGCG<br>AACCGGCAACCTCTGGCACTGAGCCATCAGGTAGCGAACCAGCAACTTCTGGTACTGAACCATCA<br>GGTACTAGCGAGCCATCTACTTCCGAACCAGGTGCAGGTAGCGAACCTGCAACCTCCGGCACTGA<br>GCCATCAGGTAGCGGCGCATCTGAACCAACCTCTACTGAACCAGGTACTTCCACCGAACCATCTG<br>AGCCAGGCAGCGCAGGTAGCGAACCTGCAACCTCCGGCACTGAGCCATCAGGTAGCGGCGCATCT<br>GAACCAACCTCTACTGAACCAGGTACTTCCACCGAACCATCTGAGCCAGGCAGCGCA | |
| BD864 | GGTAGCGAAACTGCTACTTCCGGCTCTGAGACTGCAGGTACTAGTGAATCCGCAACTAGCGAATC<br>TGGCGCAGGTAGCACTGCAGGCTCTGAGACTTCCACTGAAGCAGGTACTAGCGAGTCCGCAACCA<br>GCGAATCCGGCGCAGGTAGCGAAACTGCTACCTCTGGCTCCGAGACTGCAGGTAGCGAAACTGCA<br>ACCTCTGGCTCTGAAACTGCAGGTACTTCCACTGAAGCAAGTGAAGGCTCCGCATCAGGTACTTC<br>CACCGAAGCAAGCGAAGGCTCCGCATCAGGTACTAGTGAGTCCGCAACTAGCGAATCCGGTGCAG<br>GTAGCGAAACCGCTACCTCTGGTTCCGAAACTGCAGGTACTTCTACCGAGGCTAGCGAAGGTTCT<br>GCATCAGGTAGCACTGCTGGTTCCGAGACTTCTACTGAAGCAGGTACTAGCGAATCTGCTACTAG<br>CGAATCCGGCGCAGGTACTAGCGAATCCGCTACCAGCGAATCCGGCGCAGGTAGCGAAACTGCAA<br>CCTCTGGTTCCGAGACTGCAGGTACTAGCGAGTCCGCTACTAGCGAATCTGGCGCAGGTACTTCC<br>ACTGAAGCTAGTGAAGGTTCTGCATCAGGTAGCGAAACTGCTACTTCTGGTTCCGAACTGCAGG<br>TAGCGAAACCGCTACCTCTGGTTCCGAAACTGCAGGTACTTCTACCGAGGCTAGCGAAGGTTCTG<br>CATCAGGTAGCACTGCTGGTTCCGAGACTTCTACTGAAGCAGGTACTAGCGAGTCCGCTACTAGC<br>GAATCTGGCGCAGGTACTTCCACTGAAGCTAGTGAAGGTTCTGCATCAGGTAGCGAAACTGCTAC<br>TTCTGGTTCCGAAACTGCAGGTAGCACTGCTGGCTCCGAGACTTCTACCGAAGCAGGTAGCACTG<br>CAGGTTCCGAAACTTCCACTGAAGCAGGTAGCGAAACTGCTACCTCTGGCTCTGAGACTGCAGGT<br>ACTAGCGAATCTGCTACTAGCGAATCCGGCGCAGGTACTAGCGAATCCGCTACCAGCGAATCCGG<br>CGCAGGTAGCGAAACTGCAACCTCTGGTTCCGAGACTGCAGGTACTAGCGAATCTGCTACTAGCG<br>AATCCGGCGCAGGTACTAGCGAATCCGCTACCAGCGAATCCGGCGCAGGTAGCGAAACTGCAACC<br>TCTGGTTCCGAGACTGCAGGTAGCGAAACCGCTACCTCTGGTTCCGAAACTGCAGGTACTTCTAC<br>CGAGGCTAGCGAAGGTTCTGCATCAGGTAGCACTGCTGGTTCCGAGACTTCTACTGAAGCAGGTA<br>GCGAAACTGCTACTTCCGGCTCTGAGACTGCAGGTACTAGTGAATCCGCAACTAGCGAATCTGGC<br>GCAGGTAGCACTGCAGGCTCTGAGACTTCCACTGAAGCAGGTAGCACTGCTGGTTCCGAAACTG<br>TACCGAAGCAGGTAGCACTGCAGGTTCTGAAACCTCCACTGAAGCAGGTACTTCCACTGAGGCTA<br>GTGAAGGCTCTGCATCAGGTAGCACTGCTGGTTCCGAAACCTCTACCGAAGCAGGTAGCACTGCA<br>GGTTCTGAAACCTCCACTGAAGCAGGTACTTCCACTGAGGCTAGTGAAGGCTCTGCATCAGGTAG<br>CACTGCAGGTTCTGAGACTTCCACCGAAGCAGGTAGCGAAACTGCTACTTCTGGTTCCGAAACTG<br>CAGGTACTTCCACTGAAGCTAGTGAAGGTTCCGCATCAGGTACTAGTGAGTCCGCAACCAGCGAA<br>TCCGGCGCAGGTAGCGAAACCGCAACCTCCGGTTCTGAAACTGCAGGTACTAGCGAATCCGCAAC<br>CAGCGAATCTGGCGCAGGTACTAGTGAGTCCGCAACCAGCGAATCCGGCGCAGGTAGCGAAACCG<br>CAACCTCCGGTTCTGAAACTGCAGGTACTAGCGAATCCGCAACCAGCGAATCTGGCGCAGGTAGC<br>GAAACTGCTACTTCCGGCTCTGAGACTGCAGGTACTTCCACCGAAGCAAGCGAAGGTTCCGCATC<br>AGGTACTTCCACCGAGGCTAGTGAAGGCTCTGCATCAGGTAGCACTGCTGGCTCCGAGACTTCTA<br>CCGAAGCAGGTAGCACTGCAGGTTCCGAAACTTCCACTGAAGCAGGTAGCGAAACTGCTACCTCT<br>GGCTCTGAGACTGCAGGTACTAGCGAATCTGCTACTAGCGAATCCGGCGCAGGTACTAGCGAATC<br>CGCTACCAGCGAATCCGGCGCAGGTAGCGAAACTGCAACCTCTGGTTCCGAGACTGCAGGTAGCG<br>AAACTGCTACTTCCGGCTCCGAGACTGCAGGTAGCGAAACTGCTACTTCTGGCTCCGAAACTGCA<br>GGTACTTCTACTGAGGCTAGTGAAGGTTCCGCATCAGGTACTAGCGAGTCCGCAACCAGCGAATC<br>CGGCGCAGGTAGCGAAACTGCTACCTCTGGCTCCGAGACTGCAGGTAGCGAAACTGCAACCTCTG<br>GCTCTGAAACTGCAGGTACTAGCGAATCTGCTACTAGCGAATCCGGCGCAGGTACTAGCGAATCC<br>GCTACCAGCGAATCCGGCGCAGGTAGCGAAACTGCAACCTCTGGTTCCGAGACTGCA | 250 |

One may clone the library of XTEN-encoding genes into one or more expression vectors known in the art. To facilitate the identification of well-expressing library members, one can construct the library as fusion to a reporter protein. Non-limiting examples of suitable reporter genes are green fluorescent protein, luciferace, alkaline phosphatase, and beta-galactosidase. By screening, one can identify short XTEN sequences that can be expressed in high concentration in the host organism of choice. Subsequently, one can generate a library of random XTEN dimers and repeat the screen for high level of expression. Subsequently, one can screen the resulting constructs for a number of properties such as level of expression, protease stability, or binding to antiserum.

One aspect of the invention is to provide polynucleotide sequences encoding the components of the fusion protein wherein the creation of the sequence has undergone codon optimization. Of particular interest is codon optimization with the goal of improving expression of the polypeptide compositions and to improve the genetic stability of the encoding gene in the production hosts. For example, codon optimization is of particular importance for XTEN sequences that are rich in glycine or that have very repetitive amino acid sequences. Codon optimization can be performed using computer programs (Gustafsson, C., et al. (2004) *Trends Biotechnol*, 22: 346-53), some of which minimize ribosomal pausing (Coda Genomics Inc.). In one embodiment, one can perform codon optimization by constructing codon libraries where all members of the library encode the same amino acid sequence but where codon usage is varied. Such libraries can be screened for highly expressing and genetically stable members that are particularly suitable for the large-scale production of XTEN-containing products. When designing XTEN sequences one can consider a number of properties. One can minimize the repetitiveness in the encoding DNA sequences. In addition, one can avoid or minimize the use of codons that are rarely used by the production host (e.g. the AGG and AGA arginine codons and one leucine codon in *E. coli*). In the case of *E. coli*, two glycine codons, GGA and GGG, are rarely used in highly expressed proteins. Thus codon optimization of the gene encoding XTEN sequences can be very desirable. DNA sequences that have a high level of glycine tend to have a high GC content that can lead to instability or low expression levels. Thus, when possible, it is preferred to choose codons such that the GC-content of XTEN-encoding sequence is suitable for the production organism that will be used to manufacture the XTEN.

Optionally, the full-length XTEN-encoding gene may comprise one or more sequencing islands. In this context, sequencing islands are short-stretch sequences that are distinct from the XTEN library construct sequences and that include a restriction site not present or expected to be present in the full-length XTEN-encoding gene. In one embodiment, a sequencing island is the sequence (SEQ ID NO: 251)
5'-AGGTGCAAGCGCAAGCGGCGCGCCAAGCACGGGAGGT-3'.

In another embodiment, a sequencing island is the sequence (SEQ ID NO: 252)
5'-AGGTCCAGAACCAACGGGGCCGGCCCCAAGCGGAGGT-3'.

As an alternative, one can construct codon libraries where all members of the library encode the same amino acid sequence but where codon usage for the respective amino acids in the sequence is varied. Such libraries can be screened for highly expressing and genetically stable members that are particularly suitable for the large-scale production of XTEN-containing products.

Optionally, one can sequence clones in the library to eliminate isolates that contain undesirable sequences. The initial library of short XTEN sequences can allow some variation in amino acid sequence. For instance one can randomize some codons such that a number of hydrophilic amino acids can occur in a particular position. During the process of iterative multimerization one can screen the resulting library members for other characteristics like solubility or protease resistance in addition to a screen for high-level expression.

Figure 2:
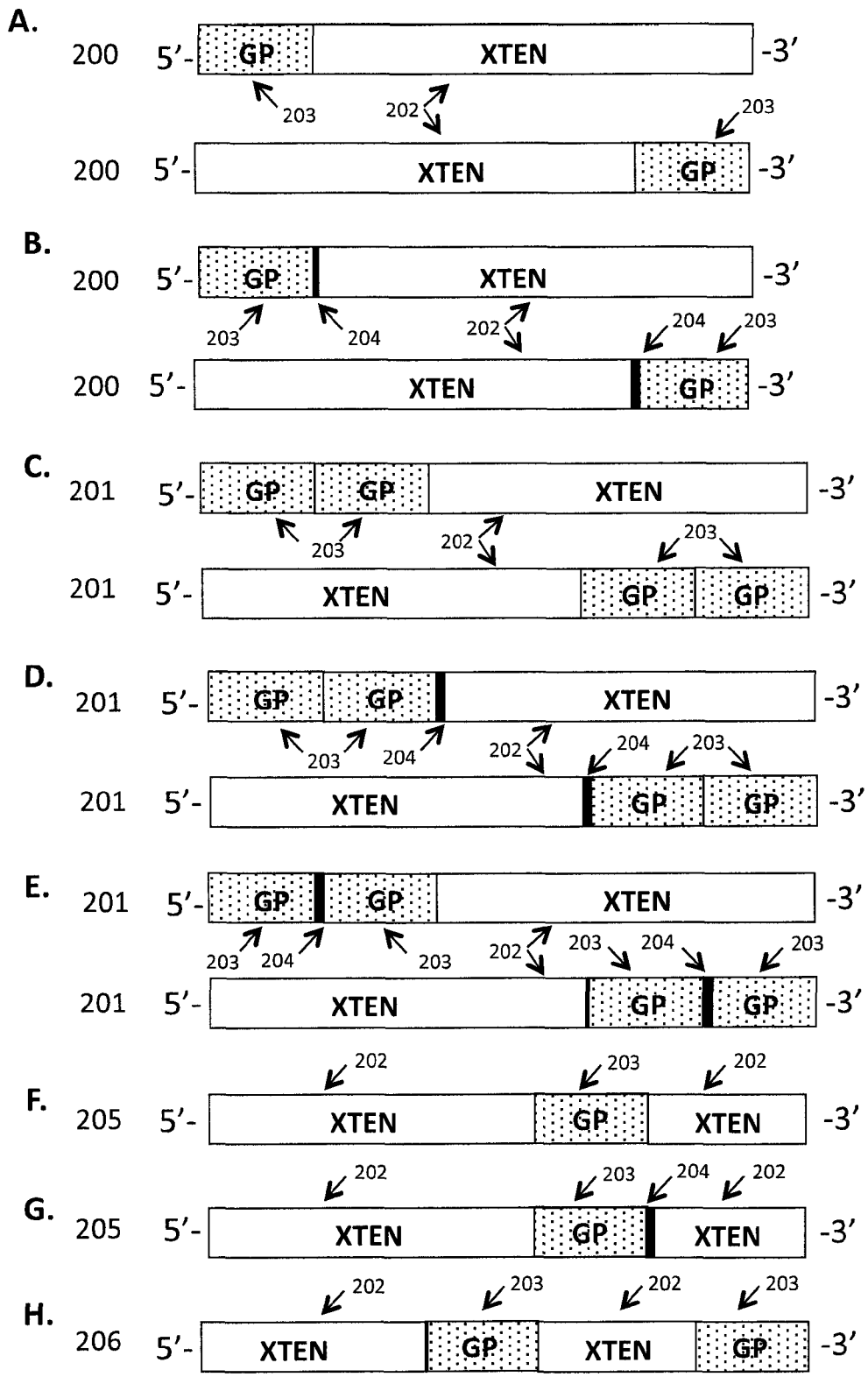
FIG. 2 is a schematic illustration of exemplary polynucleotide constructs (FIGS. 2A-H) of GPXTEN genes that encode the corresponding GPXTEN polypeptides of FIG. 1; all depicted in a 5' to 3' orientation. In these illustrative examples the genes encode GPXTEN fusion proteins with one GP and XTEN (200); or one GP, one spacer sequence and one XTEN (200); two GP and one XTEN (201); or two GP, a spacer sequence and one XTEN (201); one GP and two XTEN (205); or two GP and two XTEN (206). In these depictions, the polynucleotides encode the following components: XTEN (202), GP (203), and spacer amino acids that can include a cleavage sequence (204), with all sequences linked in frame.
Figure 3:
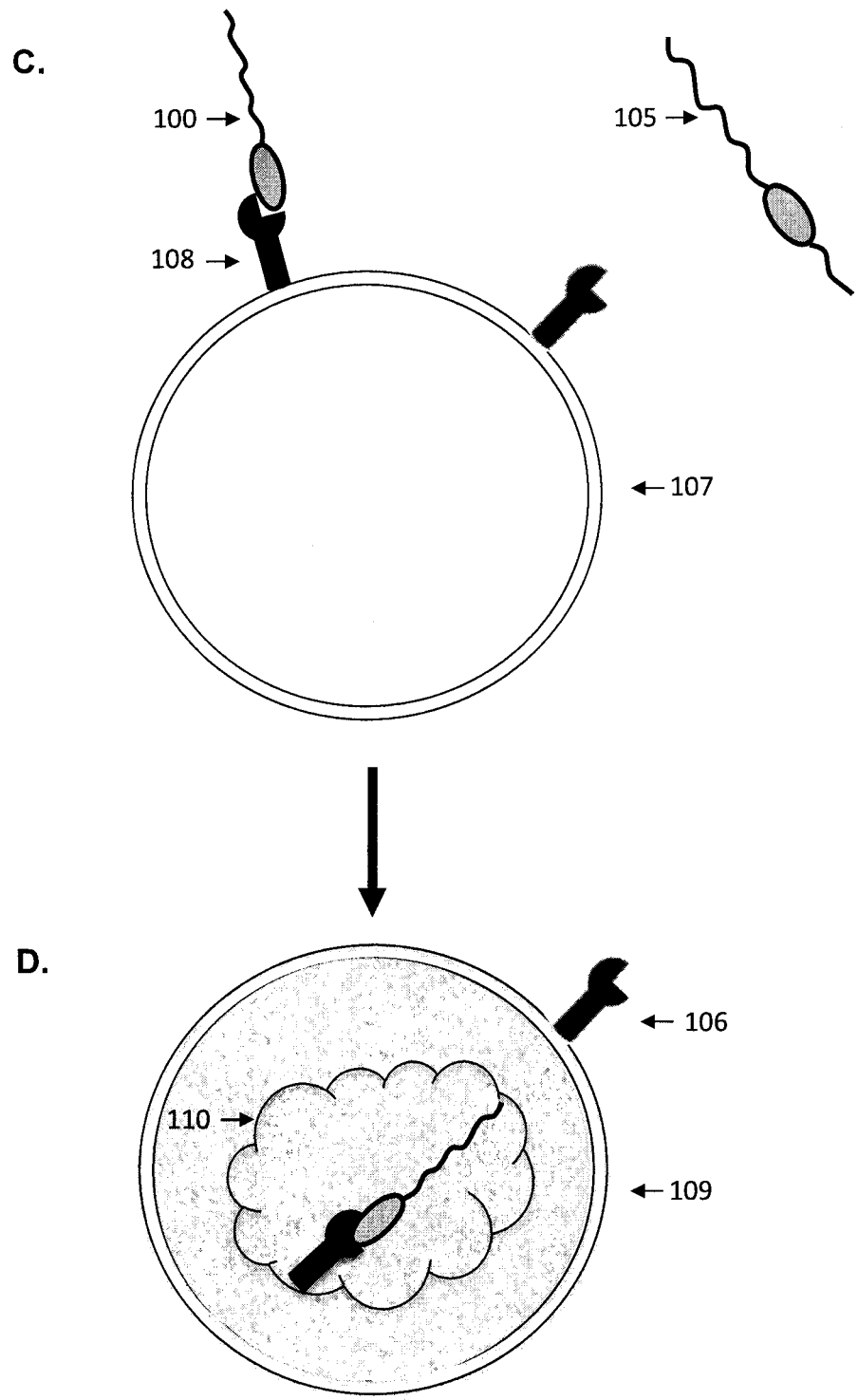
FIG. 3 is a schematic illustration of two exemplary monomeric GPXTEN and the ability of the monomeric fusion proteins to bind to a target receptor on a cell surface, with subsequent cell signaling.

Once the gene that encodes the XTEN of desired length and properties is selected, the method provides that it can be genetically fused to the nucleotides encoding the N- and/or the C-terminus of the GP gene(s) by cloning it into the construct adjacent and in frame with the gene coding for GP or, optionally, adjacent to a spacer sequence. The invention provides various permutations of the foregoing, depending on the GPXTEN to be encoded. For example, a gene encoding a GPXTEN fusion protein comprising a GP and two XTEN, such as embodied by formula VI, as depicted above, the gene would have polynucleotides encoding GP, encoding two XTEN, which can be identical or different in composition and sequence length. In one non-limiting embodiment of the foregoing, the GP polynucleotides would encode exendin-4 and the polynucleotides encoding the N-terminus XTEN would encode AE912 and the polynucleotides encoding the C-terminus XTEN would encode AE144. The step of cloning the GP genes into the XTEN construct can occur through a ligation or multimerization step. As shown in FIG. 2, the constructs encoding GPXTEN fusion proteins can be designed in different configurations of the components XTEN 202, GP 203, and spacer sequences 204. In one embodiment, as illustrated in FIG. 2A, the construct comprises polynucleotide sequences complementary to, or those that encode a monomeric polypeptide of components in the following order (5' to 3') GP 203 and XTEN 202, or the reverse order. In another embodiment, as illustrated in FIG. 2B, the construct comprises polynucleotide sequences complementary to, or those that encode a monomeric polypeptide of components in the following order (5' to 3') GP 203, spacer sequence 204, and XTEN 202, or the reverse order. In another embodiment, as illustrated in FIG. 2C, the construct 201 encodes a monomeric GPXTEN comprising polynucleotide sequences complementary to, or those that encode components in the following order (5' to 3'): two molecules of GP 203 and XTEN 202, or the reverse order. In another embodiment, as illustrated in FIG. 2D, the construct comprises polynucleotide sequences complementary to, or those that encode a monomeric polypeptide of components in the following order (5' to 3'): two molecules of GP 203, spacer sequence 204, and XTEN 202, or the reverse order. In another embodiment, as illustrated in FIG. 2E, the construct comprises polynucleotide sequences complementary to, or those that encode a monomeric polypeptide of components in the following order (5' to 3'): GP 203, spacer sequence 204, a second molecule of GP 203, and XTEN 202, or the reverse order. In another embodiment, as illustrated in FIG. 2F, the construct comprises polynucleotide sequences complementary to, or those that encode a monomeric polypeptide of components in the following order (5' to 3'): GP 203, XTEN 202, GP 203, and a second XTEN 202, or the reverse sequence. The spacer polynucleotides can optionally comprise sequences encoding cleavage sequences. As will be apparent to those of skill in the art, other permutations of the foregoing are possible.

The invention also encompasses polynucleotides comprising XTEN-encoding polynucleotide variants that have a high percentage of sequence identity to (a) a polynucleotide sequence from Table 9, or (b) sequences that are complementary to the polynucleotides of (a). A polynucleotide with a high percentage of sequence identity is one that has at least about an 80% nucleic acid sequence identity, alternatively at least about 81%, alternatively at least about 82%, alternatively at least about 83%, alternatively at least about 84%, alternatively at least about 85%, alternatively at least about 86%, alternatively at least about 87%, alternatively at least about 88%, alternatively at least about 89%, alternatively at least about 90%, alternatively at least about 91%, alternatively at least about 92%, alternatively at least about 93%, alternatively at least about 94%, alternatively at least about 95%, alternatively at least about 96%, alternatively at least about 97%, alternatively at least about 98%, and alternatively at least about 99% nucleic acid sequence identity to (a) or (b) of the foregoing, or that can hybridize with the target polynucleotide or its complement under stringent conditions.

Homology, sequence similarity or sequence identity of nucleotide or amino acid sequences may also be determined conventionally by using known software or computer programs such as the BestFit or Gap pairwise comparison programs (GCG Wisconsin Package, Genetics Computer Group, 575 Science Drive, Madison, Wis. 53711). BestFit uses the local homology algorithm of Smith and Waterman (Advances in Applied Mathematics. 1981. 2: 482-489), to find the best segment of identity or similarity between two sequences. Gap performs global alignments: all of one sequence with all of another similar sequence using the method of Needleman and Wunsch, (Journal of Molecular Biology. 1970. 48:443-453). When using a sequence alignment program such as BestFit, to determine the degree of sequence homology, similarity or identity, the default setting may be used, or an appropriate scoring matrix may be selected to optimize identity, similarity or homology scores.

Nucleic acid sequences that are "complementary" are those that are capable of base-pairing according to the standard Watson-Crick complementarity rules. As used herein, the term "complementary sequences" means nucleic acid sequences that are substantially complementary, as may be assessed by the same nucleotide comparison set forth above, or as defined as being capable of hybridizing to the polynucleotides that encode the GPXTEN sequences under stringent conditions, such as those described herein.

The resulting polynucleotides encoding the GPXTEN chimeric fusion proteins can then be individually cloned into an expression vector. The nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature.

Various vectors are publicly available. The vector may, for example, be in the form of a plasmid, cosmid, viral particle, or phage. The invention provides for the use of plasmid vectors containing replication and control sequences that are compatible with and recognized by the host cell, and are operably linked to the GPXTEN gene for controlled expression of the GPXTEN fusion proteins. The vector ordinarily carries a replication site, as well as sequences that encode proteins that are capable of providing phenotypic selection in transformed cells. For example, *E. coli* may be transformed using pBR322, a plasmid derived from an *E. coli* species (Mandel et al., J Mol. Biol., 53: 154 (1970)). Plasmid pBR322 contains genes for ampicillin and tetracycline resistance and thus provides easy means for selection. Such vector sequences are well known for a variety of bacteria, yeast, and viruses. Useful expression vectors that can be used include, for example, segments of chromosomal, non-chromosomal and synthetic DNA sequences. "Expression vector" refers to a DNA construct containing a DNA sequence that is operably linked to a suitable control sequence capable of effecting the expression of the DNA encoding the fusion protein in a suitable host. Such control sequences include a promoter to effect transcription, an optional operator sequence to control such transcription, a sequence encoding suitable mRNA ribosome binding sites, and sequences that control termination of transcription and translation. Other suitable vectors include, but are not limited to, derivatives of SV40 and pcDNA and known bacterial plasmids such as col EI, pCR1, pBR322, pMal-C2, pET, pGEX as described by Smith, et al., Gene 57:31-40 (1988), pMB9 and derivatives thereof, plasmids such as RP4, phage DNAs such as the numerous derivatives of phage I such as NM98 9, as well as other phage DNA such as M13 and filamentous single stranded phage DNA; yeast plasmids such as the 2 micron plasmid or derivatives of the 2 m plasmid, as well as centomeric and integrative yeast shuttle vectors; vectors useful in eukaryotic cells such as vectors useful in insect or mammalian cells; vectors derived from combinations of plasmids and phage DNAs, such as plasmids that have been modified to employ phage DNA or the expression control sequences; and the like. The requirements are that the vectors are replicable and viable in the host cell of choice. Low- or high-copy number vectors may be used as desired.

Promoters suitable for use in expression vectors with prokaryotic hosts include the β-lactamase and lactose promoter systems [Chang et al., Nature, 275:615 (1978); Goeddel et al., Nature, 281:544 (1979)], alkaline phosphatase, a tryptophan (trp) promoter system [Goeddel, Nucleic Acids Res., 8:4057 (1980); EP 36,776], and hybrid promoters such as the tac promoter [deBoer et al., Proc. Natl. Acad. Sci. USA, 80:21-25 (1983)], all would be operably linked to the DNA encoding GPXTEN polypeptides. Promoters for use in bacterial systems can also contain a Shine-Dalgarno (S.D.) sequence, operably linked to the DNA encoding GPXTEN polypeptides.

The invention contemplates use of other expression systems including, for example, a baculovirus expression system with both non-fusion transfer vectors, such as, but not limited to pVL941 (BamHI cloning site, available from Summers, et al., Virology 84:390-402 (1978)), pVL1393 (BamHI, SmaI, XbaI, EcoRI, IVotI, XmaIII, BgIII and PstI cloning sites; Invitrogen), pVL1392 (BgIII, PstI, NotI, XmaIII, EcoRI, XbaII, SmaI and BamHI cloning site; Summers, et al., Virology 84:390-402 (1978) and Invitrogen) and pBlueBacIII (BamHI, BgIII, PstI, NcoI and Hindi II cloning site, with blue/white recombinant screening, Invitrogen), and fusion transfer vectors such as, but not limited to, pAc7 00 (BamHI and KpnI cloning sites, in which the BamHI recognition site begins with the initiation codon; Summers, et al., Virology 84:390-402 (1978)), pAc701 and pAc70-2 (same as pAc700, with different reading frames), pAc360 [BamHI cloning site 36 base pairs downstream of a polyhedrin initiation codon; Invitrogen (1995) and pBlueBacHisA, B, C (three different reading frames with BamH I, Bgl II, PstI, Nco I and Hind III cloning site, an N-terminal peptide for ProBond purification and blue/white recombinant screening of plaques; Invitrogen (220) can be used.

Mammalian expression vectors can comprise an origin of replication, a suitable promoter and enhancer, and also any necessary ribosome binding sites, polyadenylation site, splice donor and acceptor sites, transcriptional termination sequences, and 5' flanking nontranscribed sequences. DNA sequences derived from the SV40 splice, and polyadenylation sites may be used to provide the required nontranscribed genetic elements. Mammalian expression vectors contemplated for use in the invention include vectors with inducible promoters, such as the dihydrofolate reductase promoters, any expression vector with a DHFR expression cassette or a DHFR/methotrexate co-amplification vector such as pED (PstI, SaiI, SbaI, SmaI and EcoRI cloning sites, with the vector expressing both the cloned gene and DHFR; Randal J. Kaufman, 1991, Randal J. Kaufman, Current Protocols in Molecular Biology, 16,12 (1991)). Alternatively a glutamine synthetase/methionine sulfoximine co-amplification vector, such as pEE14 (HindIII, XbaII, SmaI, SbaI, EcoRI and SelI cloning sites in which the vector expresses glutamine synthetase and the cloned gene; Celltech). A vector that directs episomal expression under the control of the Epstein Barr Virus (EBV) or nuclear antigen (EBNA) can be used such as pREP4 (BamHI r SfH, XhoI, NoII, NheI, Hindi II, NheI, PvuII and KpnI cloning sites, constitutive RSV-LTR promoter, hygromycin selectable marker; Invitrogen), pCEP4 (BamHI, SfH, XhoI, NotI, NheI, HindIII, NheI, PvuII and KpnI cloning sites, constitutive hCMV immediate early gene promoter, hygromycin selectable marker; Invitrogen), pMEP4 (KpnI, PvuI, NheI, HindIII, NotI, XhoI, SfiI, BamHI cloning sites, inducible methallothionein H a gene promoter, hygromycin selectable marker, Invitrogen), pREP8 (BamHI, XhoI, NotI, HindIII, NheI and KpnI cloning sites, RSV-LTR promoter, histidinol selectable marker; Invitrogen), pREP9 (KpnI, NheI, Hind III, NotI, Xho I, Sfi I, BamH I cloning sites, RSV-LTR promoter, G418 selectable marker; Invitrogen), and pEBVHis (RSV-LTR promoter, hygromycin selectable marker, N-terminal peptide purifiable via ProBond resin and cleaved by enterokinase; Invitrogen).

Selectable mammalian expression vectors for use in the invention include, but are not limited to, pRc/CMV (Hind III, BstXI, NotI, SbaI and ApaI cloning sites, G418 selection, Invitrogen), pRc/RSV (Hind II SpeI, BstXI, NotI, XbaI cloning sites, G418 selection, Invitrogen) and the like. Vaccinia virus mammalian expression vectors (see, for example, Randall J. Kaufman, Current Protocols in Molecular Biology 16.12 (Frederick M. Ausubel, et al., eds. Wiley 1991) that can be used in the present invention include, but are not limited to, pSC11 (SmaI cloning site, TK- and beta-gal selection), pMJ601 (Sal I, Sma I, A fII, NarI, BspMII, BamHI, ApaI, NheI, SacII, KpnI and HindIII cloning sites; TK- and -gal selection), pTKgptFIS (EcoRI, PstI, SalII, AccI, HindII, SbaI, BamHI and Hpa cloning sites, TK or XPRT selection) and the like.

Yeast expression systems that can also be used in the present invention include, but are not limited to, the non-fusion pYES2 vector (XJbaI, SphI, ShoI, NotI, GstXI, EcoRI, BstXI, BamHI, Sad, KpnI and HindIII cloning sites, Invitrogen), the fusion pYESHisA, B, C (XbaII, SphI, ShoI, NotI, BstXI, EcoRI, BamHI, Sad, KpnI and Hindi II cloning sites, N-terminal peptide purified with ProBond resin and cleaved with enterokinase; Invitrogen), pRS vectors and the like.

In addition, the expression vector containing the chimeric GPXTEN fusion protein-encoding polynucleotide molecule may include drug selection markers. Such markers aid in cloning and in the selection or identification of vectors containing chimeric DNA molecules. For example, genes that confer resistance to neomycin, puromycin, hygromycin, dihydrofolate reductase (DHFR) inhibitor, guanine phosphoribosyl transferase (GPT), zeocin, and histidinol are useful selectable markers. Alternatively, enzymes such as herpes simplex virus thymidine kinase (tk) or chloramphenicol acetyltransferase (CAT) may be employed. Immunologic markers also can be employed. Any known selectable marker may be employed so long as it is capable of being expressed simultaneously with the nucleic acid encoding a gene product. Further examples of selectable markers are well known to one of skill in the art and include reporters such as enhanced green fluorescent protein (EGFP), beta-galactosidase (β-gal) or chloramphenicol acetyltransferase (CAT).

In one embodiment, the polynucleotide encoding a GPXTEN fusion protein composition can be fused C-terminally to an N-terminal signal sequence appropriate for the expression host system. Signal sequences are typically proteolytically removed from the protein during the translocation and secretion process, generating a defined N-terminus. A wide variety of signal sequences have been described for most expression systems, including bacterial, yeast, insect, and mammalian systems. A non-limiting list of preferred examples for each expression system follows herein. Preferred signal sequences are OmpA, PhoA, and DsbA for *E. coli* expression. Signal peptides preferred for yeast expression are ppL-alpha, DEX4, invertase signal peptide, acid phosphatase signal peptide, CPY, or INU 1. For insect cell expression the preferred signal sequences are sexta adipokinetic hormone precursor, CP1, CP2, CP3, CP4, TPA, PAP, or gp67. For mammalian expression the preferred signal sequences are IL2L, SV40, IgG kappa and IgG lambda.

In another embodiment, a leader sequence, potentially comprising a well-expressed, independent protein domain, can be fused to the N-terminus of the GPXTEN sequence, separated by a protease cleavage site. While any leader peptide sequence which does not inhibit cleavage at the designed proteolytic site can be used, sequences in preferred embodiments will comprise stable, well-expressed sequences such that expression and folding of the overall composition is not significantly adversely affected, and preferably expression, solubility, and/or folding efficiency are significantly improved. A wide variety of suitable leader sequences have been described in the literature. A non-limiting list of suitable sequences includes maltose binding protein, cellulose binding domain, glutathione S-transferase, 6×His tag (SEQ ID NO: 253), FLAG tag, hemaglutinin tag, and green fluorescent protein. The leader sequence can also be further improved by codon optimization, especially in the second codon position following the ATG start codon, by methods well described in the literature and hereinabove.

Various in vitro enzymatic methods for cleaving proteins at specific sites are known. Such methods include use of enterokinase (DDDK (SEQ ID NO: 254)), Factor Xa (IDGR (SEQ ID NO: 255)), thrombin (LVPRGS (SEQ ID NO: 256)), PreScission™ (LEVLFQGP (SEQ ID NO: 257)), TEV protease (EQLYFQG (SEQ ID NO: 258)), 3C protease (ETLFQGP (SEQ ID NO: 259)), Sortase A (LPETG (SEQ ID NO: 260)), Granzyme B (D/X, N/X, M/N or S/X), inteins, SUMO, DAPase (TAGZyme™), Aeromonas aminopeptidase, Aminopeptidase M, and carboxypeptidases A and B. Additional methods are disclosed in Arnau, et al., Protein Expression and Purification 48: 1-13 (2006).

In other cases, the invention provides polynucleotide constructs and methods of making constructs (e.g., as described in the Examples) comprising an optimized polynucleotide sequence encoding at least about 20 to about 60 amino acids with XTEN characteristics can be included at the N-terminus of the XTEN-encoding sequence to promote the initiation of translation to allow for expression of XTEN fusions at the N-terminus of proteins without the presence of a helper domain. In an advantage of the foregoing, the sequence does not require subsequent cleavage of a helper domain, thereby reducing the number of steps to manufacture XTEN-containing compositions. As described in more detail in the Examples, the optimized N-terminal sequence has attributes of an unstructured protein, but may include nucleotide bases encoding amino acids selected for their ability to promote initiation of translation and enhanced expression. In one embodiment of the foregoing, the optimized polynucleotide encodes an XTEN sequence with at least about 90% sequence identity to AE912. In another embodiment of the foregoing, the optimized polynucleotide encodes an XTEN sequence with at least about 90% sequence identity to AM923. In another embodiment of the foregoing, the optimized polynucleotide encodes an XTEN sequence with at least about 90% sequence identity to AE624. In another embodiment of the foregoing, the optimized polynucleotide encodes an XTEN sequence with at least about 90% sequence identity to AE48. In another embodiment of the foregoing, the optimized polynucleotide encodes an XTEN sequence with at least about 90% sequence identity to AM48. In one embodiment, the optimized polynucleotide NTS comprises a sequence that exhibits at least about 80%, at least about 85%, at least about 90%, at least about 91%, at least about 92%, at least about 93%, at least about 94%, at least about 95%, at least about 96%, at least about 97%, at least about 98%, or at least about 99%, sequence identity to a sequence or its complement selected from

AE 48: (SEQ ID NO: 261)
5'-

ATGGCTGAACCTGCTGGCTCTCCAACCTCCACTGAGGAAGGTACCCCGGG

TAGCGGTACTGCTTCTTCCTCTCCAGGTAGCTCTACCCCTTCTGGTGCAA

CCGGCTCTCCAGGTGCTTCTCCGGGCACCAGCTCTACCGGTTCTCCA-3' and
AM 48: 5'-ATGGCTGAACCTGCTGGCTCTCCAAC-CTCCACTGAGGAAGGTGCATC-CCCGGGCACCAGCTCTA CCGGTTCTCCAGG-TAGCTCTACCCCGTCTGGTGCTACCGGCTCTCCAG-GTAGCTCTACCCCGTCT GGTGCTACTGGCTCTCCA-3' (SEQ ID NO: 262)

In another embodiment, the protease site of the leader sequence construct is chosen such that it is recognized by an in vivo protease. In this embodiment, the protein is purified from the expression system while retaining the leader by avoiding contact with an appropriate protease. The full-length construct is then injected into a patient. Upon injection, the construct comes into contact with the protease specific for the cleavage site and is cleaved by the protease. In the case where the uncleaved protein is substantially less active than the cleaved form, this method has the beneficial effect of allowing higher initial doses while avoiding toxicity, as the active form is generated slowly in vivo. Some non-limiting examples of in vivo proteases which are useful for this application include tissue kallikrein, plasma kallikrein, trypsin, pepsin, chymotrypsin, thrombin, and matrix metalloproteinases, or the proteases of Table 8.

In this manner, a chimeric DNA molecule coding for a monomeric GPXTEN fusion protein is generated within the construct. Optionally, this chimeric DNA molecule may be transferred or cloned into another construct that is a more appropriate expression vector. At this point, a host cell capable of expressing the chimeric DNA molecule can be transformed with the chimeric DNA molecule. The vectors containing the DNA segments of interest can be transferred into the host cell by well-known methods, depending on the type of cellular host. For example, calcium chloride transfection is commonly utilized for prokaryotic cells, whereas calcium phosphate treatment, lipofection, or electroporation may be used for other cellular hosts. Other methods used to transform mammalian cells include the use of polybrene, protoplast fusion, liposomes, electroporation, and microinjection. See, generally, Sambrook, et al., supra.

The transformation may occur with or without the utilization of a carrier, such as an expression vector. Then, the transformed host cell is cultured under conditions suitable for expression of the chimeric DNA molecule encoding of GPX-TEN.

The present invention also provides a host cell for expressing the monomeric fusion protein compositions disclosed herein. Examples of suitable eukaryotic host cells include, but are not limited to mammalian cells, such as VERO cells, HELA cells such as ATCC No. CCL2, CHO cell lines, COS cells, WI38 cells, BHK cells, HepG2 cells, 3T3 cells, A549 cells, PC12 cells, K562 cells, 293 cells, Sf9 cells and CvI cells. Examples of suitable non-mammalian eukaryotic cells include eukaryotic microbes such as filamentous fungi or yeast are suitable cloning or expression hosts for encoding vectors. *Saccharomyces cerevisiae* is a commonly used lower eukaryotic host microorganism. Others include *Schizosaccharomyces pombe* (Beach and Nurse, Nature, 290: 140 [1981]; EP 139,383 published 2 May 1985); *Kluyveromyces* hosts (U.S. Pat. No. 4,943,529; Fleer et al., Bio/Technology, 9:968-975 (1991)) such as, e.g., *K. lactis* (MW98-8C, CBS683, CBS4574; Louvencourt et al., J. Bacteriol., 737 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., Bio/Technology, 8:135 (1990)), *K. thermotolerans*, and *K. marxianus*; *yarrowia* (EP 402,226); *Pichia pastoris* (EP 183,070; Sreekrishna et al., J. Basic Microbiol., 28:265-278 [1988]); *Candida*; *Trichoderma reesia* (EP 244,234); *Neurospora crassa* (Case et al., Proc. Natl. Acad. Sci. USA, 76:5259-5263 [1979]); *Schwanniomyces* such as *Schwanniomyces occidentalis* (EP 394,538 published 31 Oct. 1990); and filamentous fungi such as, e.g., *Neurospora, Penicillium, Tolypocladium* (WO 91/00357 published 10 Jan. 1991), and *Aspergillus* hosts such as *A. nidulans* (Ballance et al., Biochem. Biophys. Res. Commun., 112:284-289 [1983]; Tilburn et al., Gene, 26:205-221 [1983]; Yelton et al., Proc. Natl. Acad. Sci. USA, 81: 1470-1474 [1984]) and *A. niger* (Kelly and Hynes, EMBO J., 4:475-479 [1985]). Methylotropic yeasts are suitable herein and include, but are not limited to, yeast capable of growth on methanol selected from the genera consisting of *Hansenula, Candida, Kloeckera, Pichia, Saccharomyces, Torulopsis*, and *Rhodotorula*. A list of specific species that are exemplary of this class of yeasts may be found in C. Anthony, The Biochemistry of Methylotrophs, 269 (1982).

Other suitable cells that can be used in the present invention include, but are not limited to, prokaryotic host cells strains such as *Escherichia coli*, (e.g., strain DH5-α), *Bacillus subtilis, Salmonella typhimurium*, or strains of the genera of *Pseudomonas, Streptomyces* and *Staphylococcus*. Non-limiting examples of suitable prokaryotes include those from the genera: *Actinoplanes; Archaeoglobus; Bdellovibrio; Borrelia; Chloroflexus; Enterococcus; Escherichia; Lactobacillus; Listeria; Oceanobacillus; Paracoccus; Pseudomonas; Staphylococcus; Streptococcus; Streptomyces; Thermoplasma*; and *Vibrio*. Non-limiting examples of specific strains include: *Archaeoglobus fulgidus; Bdellovibrio bacteriovorus; Borrelia burgdorferi; Chloroflexus aurantiacus; Enterococcus faecalis; Enterococcus faecium; Lactobacillus johnsonii; Lactobacillus plantarum; Lactococcus lactis; Listeria innocua; Listeria monocytogenes; Oceanobacillus iheyensis; Paracoccus zeaxanthinifaciens; Pseudomonas mevalonii; Staphylococcus aureus; Staphylococcus epidermidis; Staphylococcus haemolyticus; Streptococcus agalactiae; Streptomyces griseolosporeus; Streptococcus mutans; Streptococcus pneumoniae; Streptococcus pyogenes; Thermoplasma acidophilum; Thermoplasma volcanium; Vibrio cholerae; Vibrio parahaemolyticus;* and *Vibrio vulnificus*.

Host cells containing the polynucleotides of interest can be cultured in conventional nutrient media (e.g., Ham's nutrient mixture) modified as appropriate for activating promoters, selecting transformants or amplifying genes. The culture conditions, such as temperature, pH and the like, are those previously used with the host cell selected for expression, and will be apparent to the ordinarily skilled artisan. Cells are typically harvested by centrifugation, disrupted by physical or chemical means, and the resulting crude extract retained for further purification. For compositions secreted by the host cells, supernatant from centrifugation is separated and retained for further purification. Microbial cells employed in expression of proteins can be disrupted by any convenient method, including freeze-thaw cycling, sonication, mechanical disruption, or use of cell lysing agents, all of which are well known to those skilled in the art. Embodiments that involve cell lysis may entail use of a buffer that contains protease inhibitors that limit degradation after expression of the chimeric DNA molecule. Suitable protease inhibitors include, but are not limited to leupeptin, pepstatin or aprotinin. The supernatant then may be precipitated in successively increasing concentrations of saturated ammonium sulfate.

Gene expression may be measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological of fluorescent methods, such as immunohistochemical staining of cells or tissue sections and assay of cell culture or body fluids or the detection of selectable markers, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence GP polypeptide or against a synthetic peptide based on the DNA sequences provided herein or against exogenous sequence fused to GP and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

Expressed GPXTEN polypeptide product(s) may be purified via methods known in the art or by methods disclosed herein. Procedures such as gel filtration, affinity purification, salt fractionation, ion exchange chromatography, size exclusion chromatography, hydroxyapatite adsorption chromatography, hydrophobic interaction chromatography and gel electrophoresis may be used; each tailored to recover and purify the fusion protein produced by the respective host cells. Some expressed GPXTEN may require refolding during isolation and purification. Methods of purification are described in Robert K. Scopes, Protein Purification: Principles and Practice, Charles R. Castor (ed.), Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994).

VIII) Pharmaceutical Compositions

The present invention provides pharmaceutical compositions comprising GPXTEN. In one embodiment, the pharmaceutical composition comprises the GPXTEN fusion protein and at least one pharmaceutically acceptable carrier. GPXTEN polypeptides of the present invention can be formulated according to known methods to prepare pharmaceutically useful compositions, whereby the polypeptide is combined in admixture with a pharmaceutically acceptable carrier vehicle, such as aqueous solutions or buffers, pharmaceutically acceptable suspensions and emulsions. Examples of non-aqueous solvents include propyl ethylene glycol, polyethylene glycol and vegetable oils. Therapeutic formulations are prepared for storage by mixing the active ingredient having the desired degree of purity with optional physiologically acceptable carriers, excipients or stabilizers, as described in Remington's Pharmaceutical Sciences 16th edition, Osol, A. Ed. (1980), in the form of lyophilized formulations or aqueous solutions.

The pharmaceutical compositions can be administered orally, intranasally, parenterally or by inhalation therapy, and may take the form of tablets, lozenges, granules, capsules, pills, ampoules, suppositories or aerosol form. They may also take the form of suspensions, solutions and emulsions of the active ingredient in aqueous or nonaqueous diluents, syrups, granulates or powders. In addition, the pharmaceutical compositions can also contain other pharmaceutically active compounds or a plurality of compounds of the invention.

More particularly, the present pharmaceutical compositions may be administered for therapy by any suitable route including oral, rectal, nasal, topical (including transdermal, aerosol, buccal and sublingual), vaginal, parenteral (including subcutaneous, subcutaneous by infusion pump, intramuscular, intravenous and intradermal), intravitreal, and pulmonary. It will also be appreciated that the preferred route will vary with the condition and age of the recipient, and the disease being treated.

In one embodiment, the pharmaceutical composition is administered subcutaneously. In this embodiment, the composition may be supplied as a lyophilized powder to be reconstituted prior to administration. The composition may also be supplied in a liquid form, which can be administered directly to a patient. In one embodiment, the composition is supplied as a liquid in a pre-filled syringe such that a patient can easily self-administer the composition.

Extended release formulations useful in the present invention may be oral formulations comprising a matrix and a coating composition. Suitable matrix materials may include waxes (e.g., camauba, bees wax, paraffin wax, ceresine, shellac wax, fatty acids, and fatty alcohols), oils, hardened oils or fats (e.g., hardened rapeseed oil, castor oil, beef tallow, palm oil, and soya bean oil), and polymers (e.g., hydroxypropyl cellulose, polyvinylpyrrolidone, hydroxypropyl methyl cellulose, and polyethylene glycol). Other suitable matrix tabletting materials are microcrystalline cellulose, powdered cellulose, hydroxypropyl cellulose, ethyl cellulose, with other carriers, and fillers. Tablets may also contain granulates, coated powders, or pellets. Tablets may also be multi-layered. Multi-layered tablets are especially preferred when the active ingredients have markedly different pharmacokinetic profiles. Optionally, the finished tablet may be coated or uncoated.

The coating composition may comprise an insoluble matrix polymer and/or a water soluble material. Water soluble materials can be polymers such as polyethylene glycol, hydroxypropyl cellulose, hydroxypropyl methyl cellulose, polyvinylpyrrolidone, polyvinyl alcohol, or monomeric materials such as sugars (e.g., lactose, sucrose, fructose, mannitol and the like), salts (e.g., sodium chloride, potassium chloride and the like), organic acids (e.g., fumaric acid, succinic acid, lactic acid, and tartaric acid), and mixtures thereof. Optionally, an enteric polymer may be incorporated into the coating composition. Suitable enteric polymers include hydroxypropyl methyl cellulose, acetate succinate, hydroxypropyl methyl cellulose, phthalate, polyvinyl acetate phthalate, cellulose acetate phthalate, cellulose acetate trimellitate, shellac, zein, and polymethacrylates containing carboxyl groups. The coating composition may be plasticised by adding suitable plasticisers such as, for example, diethyl phthalate, citrate esters, polyethylene glycol, glycerol, acetylated glycerides, acetylated citrate esters, dibutylsebacate, and castor oil. The coating composition may also include a filler, which can be an insoluble material such as silicon dioxide, titanium dioxide, talc, kaolin, alumina, starch, powdered cellulose, MCC, or polacrilin potassium. The coating composition may be applied as a solution or latex in organic solvents or aqueous solvents or mixtures thereof. Solvents such as water, lower alcohol, lower chlorinated hydrocarbons, ketones, or mixtures thereof may be used.

The compositions of the invention may be formulated using a variety of excipients. Suitable excipients include microcrystalline cellulose (e.g. Avicel PH102, Avicel PH101), polymethacrylate, poly(ethyl acrylate, methyl methacrylate, trimethylammonioethyl methacrylate chloride) (such as Eudragit RS-30D), hydroxypropyl methylcellulose (Methocel K100M, Premium CR Methocel K100M, Methocel E5, Opadry®), magnesium stearate, talc, triethyl citrate, aqueous ethylcellulose dispersion (Surelease®), and protamine sulfate. The slow release agent may also comprise a carrier, which can comprise, for example, solvents, dispersion media, coatings, antibacterial and antifungal agents, isotonic and absorption delaying agents. Pharmaceutically acceptable salts can also be used in these slow release agents, for example, mineral salts such as hydrochlorides, hydrobromides, phosphates, or sulfates, as well as the salts of organic acids such as acetates, proprionates, malonates, or benzoates. The composition may also contain liquids, such as water, saline, glycerol, and ethanol, as well as substances such as wetting agents, emulsifying agents, or pH buffering agents. Liposomes may also be used as a carrier.

In another embodiment, the compositions of the present invention are encapsulated in liposomes, which have demonstrated utility in delivering beneficial active agents in a controlled manner over prolonged periods of time. Liposomes are closed bilayer membranes containing an entrapped aqueous volume. Liposomes may also be unilamellar vesicles possessing a single membrane bilayer or multilamellar vesicles with multiple membrane bilayers, each separated from the next by an aqueous layer. The structure of the resulting membrane bilayer is such that the hydrophobic (nonpolar) tails of the lipid are oriented toward the center of the bilayer while the hydrophilic (polar) heads orient towards the aqueous phase. In one embodiment, the liposome may be coated with a flexible water soluble polymer that avoids uptake by the organs of the mononuclear phagocyte system, primarily the liver and spleen. Suitable hydrophilic polymers for surrounding the liposomes include, without limitation, PEG, polyvinylpyrrolidone, polyvinylmethylether, polymethyloxazoline, polyethyloxazoline, polyhydroxypropyloxazoline, polyhydroxypropylmethacrylamide, polymethacrylamide, polydimethylacrylamide, polyhydroxypropylmethacry late, polyhydroxethylacrylate, hydroxymethylcellulose hydroxyethylcellulose, polyethyleneglycol, polyaspartamide and hydrophilic peptide sequences as described in U.S. Pat. Nos. 6,316,024; 6,126, 966; 6,056,973; 6,043,094, the contents of which are incorporated by reference in their entirety.

Liposomes may be comprised of any lipid or lipid combination known in the art. For example, the vesicle-forming lipids may be naturally-occurring or synthetic lipids, including phospholipids, such as phosphatidylcholine, phosphatidylethanolamine, phosphatidic acid, phosphatidylserine, phasphatidylglycerol, phosphatidylinositol, and sphingomyelin as disclosed in U.S. Pat. Nos. 6,056,973 and 5,874,104. The vesicle-forming lipids may also be glycolipids, cerebrosides, or cationic lipids, such as 1,2-dioleyloxy-3-(trimethylamino) propane (DOTAP); N-[1-(2,3,-ditetradecyloxy)propyl]-N,N-dimethyl-N-hydroxyethylammonium bromide (DMRIE); N-[1[(2,3,-dioleyloxy)propyl]-N,N-dimethyl-N-hydroxy ethylammonium bromide (DORIE); N-[1-(2,3-dioleyloxy)propyl]-N,N,N-trimethylammonium chloride (DOTMA); 3 [N—(N',N'-dimethylaminoethane)carbamoly] cholesterol (DC-Chol); or dimethyldioctadecylammonium (DDAB) also as disclosed in U.S. Pat. No. 6,056,973. Cholesterol may also be present in the proper range to impart stability to the vesicle as disclosed in U.S. Pat. Nos. 5,916,588 and 5,874,104.

Additional liposomal technologies are described in U.S. Pat. Nos. 6,759,057; 6,406,713; 6,352,716; 6,316,024; 6,294, 191; 6,126,966; 6,056,973; 6,043,094; 5,965,156; 5,916,588; 5,874,104; 5,215,680; and 4,684,479, the contents of which are incorporated herein by reference. These describe liposomes and lipid-coated microbubbles, and methods for their manufacture. Thus, one skilled in the art, considering both the disclosure of this invention and the disclosures of these other patents could produce a liposome for the extended release of the polypeptides of the present invention.

For liquid formulations, a desired property is that the formulation be supplied in a form that can pass through a 25, 28, 30, 31, 32 gauge needle for intravenous, intramuscular, intraarticular, or subcutaneous administration.

Administration via transdermal formulations can be performed using methods also known in the art, including those described generally in, e.g., U.S. Pat. Nos. 5,186,938 and 6,183,770, 4,861,800, 6,743,211, 6,945,952, 4,284,444, and WO 89/09051, incorporated herein by reference in their entireties. A transdermal patch is a particularly useful embodiment with polypeptides having absorption problems. Patches can be made to control the release of skin-permeable active ingredients over a 12 hour, 24 hour, 3 day, and 7 day period. In one example, a 2-fold daily excess of a polypeptide of the present invention is placed in a non-volatile fluid. The compositions of the invention are provided in the form of a viscous, non-volatile liquid. The penetration through skin of specific formulations may be measures by standard methods in the art (for example, Franz et al., J. Invest. Derm. 64:194-195 (1975)). Examples of suitable patches are passive transfer skin patches, iontophoretic skin patches, or patches with microneedles such as Nicoderm.

In other embodiments, the composition may be delivered via intranasal, buccal, or sublingual routes to the brain to enable transfer of the active agents through the olfactory passages into the CNS and reducing the systemic administration. Devices commonly used for this route of administration are included in U.S. Pat. No. 6,715,485. Compositions delivered via this route may enable increased CNS dosing or reduced total body burden reducing systemic toxicity risks associated with certain drugs. Preparation of a pharmaceutical composition for delivery in a subdermally implantable device can be performed using methods known in the art, such as those described in, e.g., U.S. Pat. Nos. 3,992,518; 5,660,848; and 5,756,115.

Osmotic pumps may be used as slow release agents in the form of tablets, pills, capsules or implantable devices. Osmotic pumps are well known in the art and readily available to one of ordinary skill in the art from companies experienced in providing osmotic pumps for extended release drug delivery. Examples are ALZA's DUROS™; ALZA's OROS™; Osmotica Pharmaceutical's Osmodex™ system; Shire Laboratories' EnSoTrol™ system; and Alzet™. Patents that describe osmotic pump technology are U.S. Pat. Nos. 6,890,918; 6,838,093; 6,814,979; 6,713,086; 6,534,090; 6,514,532; 6,361,796; 6,352,721; 6,294,201; 6,284,276; 6,110,498; 5,573,776; 4,200,0984; and 4,088,864, the contents of which are incorporated herein by reference. One skilled in the art, considering both the disclosure of this invention and the disclosures of these other patents could produce an osmotic pump for the extended release of the polypeptides of the present invention.

Syringe pumps may also be used as slow release agents. Such devices are described in U.S. Pat. Nos. 4,976,696; 4,933,185; 5,017,378; 6,309,370; 6,254,573; 4,435,173; 4,398,908; 6,572,585; 5,298,022; 5,176,502; 5,492,534; 5,318,540; and 4,988,337, the contents of which are incorporated herein by reference. One skilled in the art, considering both the disclosure of this invention and the disclosures of these other patents could produce a syringe pump for the extended release of the compositions of the present invention.

IX) Pharmaceutical Kits

In another aspect, the invention provides a kit to facilitate the use of the GPXTEN polypeptides. The kit comprises the pharmaceutical composition provided herein, a label identifying the pharmaceutical composition, and an instruction for storage, reconstitution and/or administration of the pharmaceutical compositions to a subject. In some embodiment, the kit comprises, preferably: (a) an amount of a GPXTEN fusion protein composition sufficient to treat a disease, condition or disorder upon administration to a subject in need thereof; and (b) an amount of a pharmaceutically acceptable carrier; together in a formulation ready for injection or for reconstitution with sterile water, buffer, or dextrose; together with a label identifying the GPXTEN drug and storage and handling conditions, and a sheet of the approved indications for the drug, instructions for the reconstitution and/or administration of the GPXTEN drug for the use for the prevention and/or treatment of a approved indication, appropriate dosage and safety information, and information identifying the lot and expiration of the drug. In another embodiment of the foregoing, the kit can comprise a second container that can carry a suitable diluent for the GPXTEN composition, which will provide the user with the appropriate concentration of GPXTEN to be delivered to the subject.

EXAMPLES

Example 1

Construction of XTEN_AD36 Motif Segments

The following example describes the construction of a collection of codon-optimized genes encoding motif sequences of 36 amino acids. As a first step, a stuffer vector pCW0359 was constructed based on a pET vector and that includes a T7 promoter. pCW0359 encodes a cellulose binding domain (CBD) and a TEV protease recognition site followed by a stuffer sequence that is flanked by BsaI, BbsI, and KpnI sites. The BsaI and BbsI sites were inserted such that they generate compatible overhangs after digestion. The stuffer sequence is followed by a truncated version of the GFP gene and a His tag. The stuffer sequence contains stop codons and thus E. coli cells carrying the stuffer plasmid pCW0359 form non-fluorescent colonies. The stuffer vector pCW0359 was digested with BsaI and KpnI to remove the stuffer segment and the resulting vector fragment was isolated by agarose gel purification. The sequences were designated XTEN_AD36, reflecting the AD family of motifs. Its segments have the amino acid sequence [X]$_3$ where X is a 12 mer peptide with the sequences: GESPGGSSGSES (SEQ ID NO: 263), GSEGSSGPGESS (SEQ ID NO: 264), GSSESGSSEGGP (SEQ ID NO: 265), or GSGGEPSESGSS (SEQ ID NO: 266). The insert was obtained by annealing the following pairs of phosphorylated synthetic oligonucleotide pairs:

```
                                            (SEQ ID NO: 267)
AD1for:    AGGTGAATCTCCDGGTGGYTCYAGCGGTTCYGARTC (SEQ ID NO: 268)
AD1rev:    ACCTGAYTCRGAACCGCTRGARCCACCHGGAGATTC (SEQ ID NO: 269)
AD2for:    AGGTAGCGAAGGTTCTTCYGGTCCDGGYGARTCYTC (SEQ ID NO: 270)
AD2rev:    ACCTGARGAYTCRCCHGGACCRGAAGAACCTTCGCT (SEQ ID NO: 271)
AD3for:    AGGTTCYTCYGAAAGCGGTTCTTCYGARGGYGGTCC (SEQ ID NO: 272)
AD3rev:    ACCTGGACCRCCYTCRGAAGAACCGCTTTCRGARGA (SEQ ID NO: 273)
AD4for:    AGGTTCYGGTGGYGAACCDTCYGARTCTGGTAGCTC
```

We also annealed the phosphorylated oligonucleotide 3KpnIstopperFor: AGGTTCGTCTTCACTCGAGGGTAC (SEQ ID NO: 274) and the non-phosphorylated oligonucleotide pr_3KpnIstopperRev: CCTCGAGTGAAGACGA (SEQ ID NO: 275). The annealed oligonucleotide pairs were ligated, which resulted in a mixture of products with varying length that represents the varying number of 12 mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0401 showed green fluorescence after induction, which shows that the sequence of XTEN_AD36 had been ligated in frame with the GFP gene and that most sequences of XTEN_AD36 had good expression levels.

We screened 96 isolates from library LCW0401 for high level of fluorescence by stamping them onto agar plate containing IPTG. The same isolates were evaluated by PCR and 48 isolates were identified that contained segments with 36 amino acids as well as strong fluorescence. These isolates were sequenced and 39 clones were identified that contained correct XTEN_AD36 segments. The file names of the nucleotide and amino acid constructs for these segments are listed in Table 10.

TABLE 10

DNA and Amino Acid Sequences for 36-mer motifs

| File name | Amino acid sequence | SEQ ID NO: | Nucleotide sequence | SEQ ID NO: |
|---|---|---|---|---|
| LCW0401_0 01_GFP- N_A01.ab1 | GSGGEPSESGSSGE SPGGSSGSESGESP GGSSGSES | 276 | GGTTCTGGTGGCGAACCGTCCGAGTCTGGTAGCTCAGG TGAATCTCCGGGTGGCTCTAGCGGTTCCGAGTCAGGTG AATCTCCTGGTGGTTCCAGCGGTTCCGAGTCA | 277 |
| LCW0401_0 02_GFP- N_B01.ab1 | GSEGSSGPGESSGE SPGGSSGSESGSSE SGSSEGGP | 278 | GGTAGCGAAGGTTCTTCTGGTCCTGGCGAGTCTTCAGG TGAATCTCCTGGTGGTTCCAGCGGTTCTGAATCAGGTT CCTCCGAAAGCGGTTCTTCCGAGGGCGGTCCA | 279 |
| LCW0401_0 03_GFP- N_C01.ab1 | GSSESGSSEGGPGS SESGSSEGGPGESP GGSSGSES | 280 | GGTTCCTCTGAAAGCGGTTCTTCCGAAGGTGGTCCAGG TTCCTCTGAAAGCGGTTCTTCTGAGGGTGGTCCAGGTG AATCTCCGGGTGGCTCCAGCGGTTCCGAGTCA | 281 |
| LCW0401_0 04_GFP- N_D01.ab1 | GSGGEPSESGSSGS SESGSSEGGPGSGG EPSESGSS | 282 | GGTTCCGGTGGCGAACCGTCTGAATCTGGTAGCTCAGG TTCTTCTGAAAGCGGTTCTTCCGAGGGTGGTCCAGGTT CTGGTGGTGAACCTTCCGAGTCTGGTAGCTCA | 283 |
| LCW0401_0 07_GFP- N_F01.ab1 | GSSESGSSEGGPGS EGSSGPGESSGSEG SSGPGESS | 284 | GGTTCTTCCGAAAGCGGTTCTTCTGAGGGTGGTCCAGG TAGCGAAGGTTCTTCCGGTCCAGGTGAGTCTTCAGGTA GCGAAGGTTCTTCTGGTCCTGGTGAATCTTCA | 285 |
| LCW0401_0 08_GFP- N_G01.ab1 | GSSESGSSEGGPGE SPGGSSGSESGSEG SSGPGESS | 286 | GGTTCCTCTGAAAGCGGTTCTTCCGAGGGTGGTCCAGG TGAATCTCCAGGTGGTTCCAGCGGTTCTGAGTCAGGTA GCGAAGGTTCTTCTGGTCCAGGTGAATCCTCA | 287 |
| LCW0401_0 12_GFP- N_H01.ab1 | GSGGEPSESGSSGS GGEPSESGSSGSEG SSGPGESS | 288 | GGTTCTGGTGGTGAACCGTCTGAGTCTGGTAGCTCAGG TTCCGGTGGCGAACCATCCGAATCTGGTAGCTCAGGTA GCGAAGGTTCTTCCGGTCCAGGTGAGTCTTCA | 289 |
| LCW0401_0 15_GFP- N_A02.ab1 | GSSESGSSEGGPGS EGSSGPGESSGESP GGSSGSES | 290 | GGTTCTTCCGAAAGCGGTTCTTCCGAAGGCGGTCCAGG TAGCGAAGGTTCTTCTGGTCCAGGCGAATCTTCAGGTG AATCTCCTGGTGGCTCCAGCGGTTCTGAGTCA | 291 |
| LCW0401_0 16_GFP- N_B02.ab1 | GSSESGSSEGGPGS SESGSSEGGPGSSE SGSSEGGP | 292 | GGTTCCTCCGAAAGCGGTTCTTCTGAGGGCGGTCCAGG TTCCTCCGAAAGCGGTTCTTCCGAGGGCGGTCCAGGTT CTTCTGAAAGCGGTTCTTCCGAGGGCGGTCCA | 293 |
| LCW0401_0 20_GFP- N_E02.ab1 | GSGGEPSESGSSGS EGSSGPGESSGSSE SGSSEGGP | 294 | GGTTCCGGTGGCGAACCGTCCGAATCTGGTAGCTCAGG TAGCGAAGGTTCTICTGGTCCAGGCGAATCTTCAGGTT CCTCTGAAAGCGGTTCTTCTGAGGGCGGTCCA | 295 |
| LCW0401_0 22_GFP- N_F02.ab1 | GSGGEPSESGSSGS SESGSSEGGPGSGG EPSESGSS | 296 | GGTTCTGGTGGTGAACCGTCCGAATCTGGTAGCTCAGG TTCTTCCGAAAGCGGTTCTTCTGAAGGTGGTCCAGGTT CCGGTGGCGAACCTTCTGAATCGGTAGCTCA | 297 |
| LCW0401_0 24_GFP- N_G02.ab1 | GSGGEPSESGSSGS SESGSSEGGPGESP GGSSGSES | 298 | GGTTCTGGTGGCGAACCGTCCGAATCTGGTAGCTCAGG TTCCTCCGAAAGCGGTTCTTCTGAAGGTGGTCCAGGTG AATCTCCAGGTGGTTCTAGCGGTTCTGAATCA | 299 |
| LCW0401_0 26_GFP- N_H02.ab1 | GSGGEPSESGSSGE SPGGSSGSESGSEG SSGPGESS | 300 | GGTTCTGGTGGCGAACCGTCTGAGTCTGGTAGCTCAGG TGAATCTCCTGGTGGCTCCAGCGGTTCTGAATCAGGTA GCGAAGGTTCTTCTGGTCCTGGTGAATCTTCA | 301 |
| LCW0401_0 27_GFP- N_A03.ab1 | GSGGEPSESGSSGE SPGGSSGSESGSGG EPSESGSS | 302 | GGTTCCGGTGGCGAACCTTCCGAATCTGGTAGCTCAGG TGAATCTCCGGGTGGTTCTAGCGGTTCTGAGTCAGGTT CTGGTGGTGAACCTTCCGAGTCTGGTAGCTCA | 303 |
| LCW0401_0 28_GFP- N_B03.ab1 | GSSESGSSEGGPGS SESGSSEGGPGSSE SGSSEGGP | 304 | GGTTCCTCTGAAAGCGGTTCTTCTGAGGGCGGTCCAGG TTCTTCCGAAAGCGGTTCTTCCGAGGGCGGTCCAGGTT CTTCCGAAAGCGGTTCTTCTGAAGGCGGTCCA | 305 |
| LCW0401_0 30_GFP- N_C03.ab1 | GESPGGSSGSESGS EGSSGPGESSGSEG SSGPGESS | 306 | GGTGAATCTCCGGGTGGCTCCAGCGGTTCTGAGTCAGG TAGCGAAGGTTCTTCCGGTCCGGGTGAGTCCTCAGGTA GCGAAGGTTCTTCCGGTCCTGGTGAGTCTTCA | 307 |
| LCW0401_0 31_GFP- N_D03.ab1 | GSGGEPSESGSSGS GGEPSESGSSGSSE SGSSEGGP | 308 | GGTTCTGGTGGCGAACCTTCCGAATCTGGTAGCTCAGG TTCCGGTGGCGAACCTTCTGAATCTGGTAGCTCAGGTT CTTCTGAAAGCGGTTCTTCCGAGGGCGGTCCA | 309 |
| LCW0401_0 33_GFP- N_E03.ab1 | GSGGEPSESGSSGS GGEPSESGSSGSGG EPSESGSS | 310 | GGTTCCGGTGGTGAACCTTCTGAATCTGGTAGCTCAGG TTCCGGTGGCGAACCATCCGAGTCTGGTAGCTCAGGTT CCGGTGGTGAACCATCCGAGTCTGGTAGCTCA | 311 |
| LCW0401_0 37_GFP- N_F03.ab1 | GSGGEPSESGSSGS SESGSSEGGPGSEG SSGPGESS | 312 | GGTTCCGGTGGCGAACCTTCTGAATCTGGTAGCTCAGG TTCCTCCGAAAGCGGTTCTTCTGAGGGCGGTCCAGGTA GCGAAGGTTCTTCTGGTCCGGGCGAGTCTTCA | 313 |

TABLE 10-continued

DNA and Amino Acid Sequences for 36-mer motifs

| File name | Amino acid sequence | SEQ ID NO: | Nucleotide sequence | SEQ ID NO: |
| --- | --- | --- | --- | --- |
| LCW0401_0 38_GFP-N_G03.ab1 | GSGGEPSESGSSGS EGSSGPGESSGGG EPSESGSS | 314 | GGTTCCGGTGGTGAACCGTCCGAGTCTGGTAGCTCAGG TAGCGAAGGTTCTTCTGGTCCGGGTGAGTCTTCAGGTT CTGGTGGCGAACCGTCCGAATCTGGTAGCTCA | 315 |
| LCW0401_0 39_GFP-N_H03.ab1 | GSGGEPSESGSSGE SPGGSSGSESGSGG EPSESGSS | 316 | GGTTCTGGTGGCGAACCGTCCGAATCTGGTAGCTCAGG TGAATCTCCTGGTGGTTCCAGCGGTTCCGAGTCAGGTT CTGGTGGCGAACCTTCCGAATCTGGTAGCTCA | 317 |
| LCW0401_0 40_GFP N_A04.ab1 | GSSESGSSEGGPGS GGEPSESGSSGSSE SGSSEGGP | 318 | GGTTCTTCCGAAAGCGGTTCTTCCGAGGGCGGTCCAGG TTCCGGTGGTGAACCATCTGAATCTGGTAGCTCAGGTT CTTCTGAAAGCGGTTCTTCTGAAGGTGGTCCA | 319 |
| LCW0401_0 42_GFP-N_C04.ab1 | GSEGSSGPGESSGE SPGGSSGSESGSEG SSGPGESS | 320 | GGTAGCGAAGGTTCTTCCGGTCCTGGTGAGTCTTCAGG TGAATCTCCAGGTGGCTCTAGCGGTTCCGAGTCAGGTA GCGAAGGTTCTTCTGGTCCTGGCGAGTCCTCA | 321 |
| LCW0401_0 46_GFP-N_D04.ab1 | GSSESGSSEGGPGS SESGSSEGGPGSSE SGSSEGGP | 322 | GGTTCCTCTGAAAGCGGTTCTTCCGAAGGCGGTCCAGG TTCTTCCGAAAGCGGTTCTTCTGAGGGCGGTCCAGGTT CCTCCGAAAGCGGTTCTTCTGAGGGTGGTCCA | 323 |
| LCW0401_0 47_GFP-N_E04.ab1 | GSGGEPSESGSSGE SPGGSSGSESGSESP GGSSGSES | 324 | GGTTCTGGTGGCGAACCTTCCGAGTCTGGTAGCTCAGG TGAATCTCCGGGTGGTTCTAGCGGTTCCGAGTCAGGTG AATCTCCGGGTGGTTCCAGCGGTTCTGAGTCA | 325 |
| LCW0401_0 51_GFP-N_F04.ab1 | GSGGEPSESGSSGS EGSSGPGESSGESP GGSSGSES | 326 | GGTTCTGGTGGCGAACCATCTGAGTCTGGTAGCTCAGG TAGCGAAGGTTCTTCCGGTCCAGGCGAGTCTTCAGGTG AATCTCCTGGTGGCTCCAGCGGTTCTGAGTCA | 327 |
| LCW0401_0 53_GFP-N_H04.ab1 | GESPGGSSGSESGE SPGGSSGSESGSESP GGSSGSES | 328 | GGTGAATCTCCTGGTGGTTCCAGCGGTTCCGAGTCAGG TGAATCTCCAGGTGGCTCTAGCGGTTCCGAGTCAGGTA ATCTCCTGGTGGTTCTAGCGGTTCTGAATCA | 329 |
| LCW0401_0 54_GFP-N_A05.ab1 | GSEGSSGPGESSGS EGSSGPGESSGGG EPSESGSS | 330 | GGTAGCGAAGGTTCTTCCGGTCCAGGTGAATCTTCAGG TAGCGAAGGTTCTTCTGGTCCTGGTGAATCCTCAGGTT CCGGTGGCGAACCATCTGAATCTGGTAGCTCA | 331 |
| LCW0401_0 59_GFP-N_D05.ab1 | GSGGEPSESGSSGS EGSSGPGESSGESP GGSSGSES | 332 | GGTTCTGGTGGCGAACCATCCGAATCTGGTAGCTCAGG TAGCGAAGGTTCTTCTGGTCCTGGCGAATCTTCAGGTG AATCTCCAGGTGGCTCTAGCGGTTCCGAATCA | 333 |
| LCW0401_0 60_GFP-N_E05.ab1 | GSGGEPSESGSSGS SESGSSEGGPGSGG EPSESGSS | 334 | GGTTCCGGTGGTGAACCGTCCGAATCTGGTAGCTCAGG TTCCTCTGAAAGCGGTTCTTCCGAGGGTGGTCCAGGTT CCGGTGGTGAACCTTCTGAGTCTGGTAGCTCA | 335 |
| LCW0401_0 61_GFP-N_F05.ab1 | GSSESGSSEGGPGS GGEPSESGSSGSEG SSGPGESS | 336 | GGTTCCTCTGAAAGCGGTTCTTCTGAGGGCGGTCCAGG TTCTGGTGGCGAACCATCTGAATCTGGTAGCTCAGGTA GCGAAGGTTCTTCCGGTCCGGGTGAATCTTCA | 337 |
| LCW0401_0 63_GFP-N_H05.ab1 | GSGGEPSESGSSGS EGSSGPGESSGSEG SSGPGESS | 338 | GGTTCTGGTGGTGAACCGTCCGAATCTGGTAGCTCAGG TAGCGAAGGTTCTTCTGGTCCTGGCGAGTCTTCAGGTA GCGAAGGTTCTTCTGGTCCTGGTGAATCTTCA | 339 |
| LCW0401_0 66_GFP-N_B06.ab1 | GSGGEPSESGSSGS SESGSSEGGPGSGG EPSESGSS | 340 | GGTTCTGGTGGCGAACCATCCGAGTCTGGTAGCTCAGG TTCTTCCGAAAGCGGTTCTTCCGAAGGCGGTCCAGGTT CTGGTGGTGAACCGTCCGAATCTGGTAGCTCA | 341 |
| LCW0401_0 67_GFP-N_C06.ab1 | GSGGEPSESGSSGE SPGGSSGSESGSESP GGSSGSES | 342 | GGTTCCGGTGGCGAACCTTCCGAATCTGGTAGCTCAGG TGAATCTCCGGGTGGTTCTAGCGGTTCCGAATCAGGTG AATCTCCAGGTGGTTCTAGCGGTTCCGAATCA | 343 |
| LCW0401_0 69_GFP-N_D06.ab1 | GSGGEPSESGSSGS GGEPSESGSSGESP GGSSGSES | 344 | GGTTCCGGTGGTGAACCATCTGAGTCTGGTAGCTCAGG TTCCGGTGGCGAACCGTCCGAGTCTGGTAGCTCAGGTG AATCTCCGGGTGGTTCCAGCGGTTCCGAATCA | 345 |
| LCW0401_0 70_GFP-N_E06.ab1 | GSEGSSGPGESSGS SESGSSEGGPGSEG SSGPGESS | 346 | GGTAGCGAAGGTTCTTCTGGTCCGGGCGAATCCTCAGG TTCCTCCGAAAGCGGTTCTTCCGAAGGTGGTCAGGTA GCGAAGGTTCTTCCGGTCCTGGTGAATCTTCA | 347 |
| LCW0401_0 78_GFP-N_F06.ab1 | GSSESGSSEGGPGE SPGGSSGSESGSESP GGSSGSES | 348 | GGTTCCTCTGAAAGCGGTTCTTCTGAAGGCGGTCCAGG TGAATCTCCGGGTGGCTCCAGCGGTTCTGAATCAGGTG AATCTCCTGGTGGCTCCAGCGGTTCCGAGTCA | 349 |

TABLE 10-continued

DNA and Amino Acid Sequences for 36-mer motifs

| File name | Amino acid sequence | SEQ ID NO: | Nucleotide sequence | SEQ ID NO: |
|---|---|---|---|---|
| LCW0401_0 79_GFP-N_G06.ab1 | GSEGSSGPGESSGS EGSSGPGESSGSGG EPSESGSS | 350 | GGTAGCGAAGGTTCTTCTGGTCCAGGCGAGTCTTCAGG TAGCGAAGGTTCTTCCGGTCCTGGCGAGTCTTCAGGTT CCGGTGGCGAACCGTCCGAATCTGGTAGCTCA | 351 |

Example 2

Construction of XTEN_AE36 Segments

A codon library encoding XTEN sequences of 36 amino acid length was constructed. The XTEN sequence was designated XTEN_AE36. Its segments have the amino acid sequence [X]$_3$ where X is a 12 mer peptide with the sequence: GSPAGSPTSTEE (SEQ ID NO: 352), GSEPATSGSE TP (SEQ ID NO: 353), GTSESA TPESGP (SEQ ID NO: 354), or GTSTEPSEGSAP (SEQ ID NO: 355). The insert was obtained by annealing the following pairs of phosphorylated synthetic oligonucleotide pairs:

```
                      (SEQ ID NO: 356)
AE1for:   AGGTAGCCCDGCWGGYTCTCCDACYTCYACYGARGA (SEQ ID NO: 357)
AE1rev:   ACCTTCYTCRGTRGARGTHGGAGARCCWGCHGGGCT (SEQ ID NO: 358)
AE2for:   AGGTAGCGAACCKGCWACYTCYGGYTCTGARACYCC (SEQ ID NO: 359)
AE2rev:   ACCTGGRGTYTCAGARCCRGARGTWGCMGGTTCGCT (SEQ ID NO: 360)
AE3for:   AGGTACYTCTGAAAGCGCWACYCCKGARTCYGGYCC (SEQ ID NO: 361)
AE3rev:   ACCTGGRCCRGAYTCMGGRGTWGCGCTTTCAGARGT (SEQ ID NO: 362)
AE4for:   AGGTACYTCTACYGAACCKTCYGARGGYAGCGCWCC (SEQ ID NO: 363)
AE4rev:   ACCTGGWGCGCTRCCYTCRGAMGGTTCRGTAGARGT
```

We also annealed the phosphorylated oligonucleotide 3KpnIstopperFor: AGGTTCGTCTTCACTCGAGGGTAC (SEQ ID NO: 364) and the non-phosphorylated oligonucleotide pr_3KpnIstopperRev: CCTCGAGTGAAGACGA (SEQ ID NO: 365). The annealed oligonucleotide pairs were ligated, which resulted in a mixture of products with varying length that represents the varying number of 12 mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0402 showed green fluorescence after induction which shows that the sequence of XTEN_AE36 had been ligated in frame with the GFP gene and most sequences of XTEN_AE36 show good expression.

We screened 96 isolates from library LCW0402 for high level of fluorescence by stamping them onto agar plate containing IPTG. The same isolates were evaluated by PCR and 48 isolates were identified that contained segments with 36 amino acids as well as strong fluorescence. These isolates were sequenced and 37 clones were identified that contained correct XTEN_AE36 segments. The file names of the nucleotide and amino acid constructs for these segments are listed in Table 11.

TABLE 11

DNA and Amino Acid Sequences for 36-mer motifs

| File name | Amino acid sequence | SEQ ID NO: | Nucleotide sequence | SEQ ID NO: |
|---|---|---|---|---|
| LCW04 02_002_ GFP-N_A07.ab1 | GSPAGSPTSTEE GTSESATPESGP GTSTEPSEGSAP | 366 | GGTAGCCCGGCAGGCTCTCCGACCTCTACTGAGGAAGGT ACTTCTGAAAGCGCAACCCCGGAGTCCGGCCCAGGTACC TCTACCGAACCGTCTGAGGGCAGCGCACCA | 367 |
| LCW04 02_003_ GFP-N_B07.ab1 | GTSTEPSEGSAP GTSTEPSEGSAP GTSTEPSEGSAP | 368 | GGTACTTCTACCGAACCGTCCGAAGGCAGCGCTCCAGGT ACCTCTACTGAACCTTCCGAGGGCAGCGCTCCAGGTACC TCTACCGAACCTTCTGAAGGTAGCGCACCA | 369 |
| LCW04 02_004_ GFP-N_C07.ab1 | GTSTEPSEGSAP GTSESATPESGP GTSESATPESGP | 370 | GGTACCTCTACCGAACCGTCTGAAGGTAGCGCACCAGGT ACCTCTGAAAGCGCAACTCCTGAGTCCGGTCCAGGTACT TCTGAAAGCGCAACCCCGGAGTCTGGCCCA | 371 |
| LCW04 02_005_ GFP-N_D07.ab1 | GTSTEPSEGSAP GTSESATPESGP GTSESATPESGP | 372 | GGTACTTCTACTGAACCGTCTGAAGGTAGCGCACCAGGT ACTTCTGAAAGCGCAACCCCGGAATCCGGCCCAGGTACC TCTGAAAGCGCAACCCCGGAGTCCGGCCCA | 373 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| LCW04 02_006_ GFP-N_E07.ab1 | GSEPATSGSETP GTSESATPESGP GSPAGSPTSTEE | 374 | GGTAGCGAACCGGCAACCTCCGGCTCTGAAACCCCAGGT ACCTCTGAAAGCGCTACTCCTGAATCCGGCCCAGGTAGC CCGGCAGGTTCTCCGACTTCCACTGAGGAA | 375 |
| LCW04 02_008_ GFP-N_F07.ab1 | GTSESATPESGP GSEPATSGSETP GTSTEPSEGSAP | 376 | GGTACTTCTGAAAGCGCAACCCCTGAATCCGGTCCAGGT AGCGAACCGGCTACTTCTGGCTCTGAGACTCCAGGTACT TCTACCGAACCGTCCGAAGGTAGCGCACCA | 377 |
| LCW04 02_009_ GFP-N_G07.ab1 | GSPAGSPTSTEE GSPAGSPTSTEE GSEPATSGSETP | 378 | GGTAGCCCGGCTGGCTCTCCAACCTCCACTGAGGAAGGT AGCCCGGCTGGCTCTCCAACCTCCACTGAAGAAGGTAGC GAACCGGCTACCTCCGGCTCTGAAACTCCA | 379 |
| LCW04 02_011_ GFP-N_A08.ab1 | GSPAGSPTSTEE GTSESATPESGP GTSTEPSEGSAP | 380 | GGTAGCCCGGCTGGCTCTCCTACCTCTACTGAGGAAGGT ACTTCTGAAAGCGCTACTCCTGAGTCTGGTCCAGGTACC TCTACTGAACCGTCCGAAGGTAGCGCTCCA | 381 |
| LCW04 02_012_ GFP-N_B08.ab1 | GSPAGSPTSTEE GSPAGSPTSTEE GTSTEPSEGSAP | 382 | GGTAGCCCTGCTGGCTCTCCGACTTCTACTGAGGAAGGT AGCCCGGCTGGTTCTCCGACTTCTACTGAGGAAGGTACT TCTACCGAACCTTCCGAAGGTAGCGCTCCA | 383 |
| LCW04 02_013_ GFP-N_C08.ab1 | GTSESATPESGP GTSTEPSEGSAP GTSTEPSEGSAP | 384 | GGTACTTCTGAAAGCGCTACTCCGGAGTCCGGTCCAGGT ACCTCTACCGAACCGTCCGAAGGCAGCGCTCCAGGTACT TCTACTGAACCTTCTGAGGGTAGCGCTCCA | 385 |
| LCW04 02_014_ GFP-N_D08.ab1 | GTSTEPSEGSAP GSPAGSPTSTEE GTSTEPSEGSAP | 386 | GGTACCTCTACCGAACCTTCCGAAGGTAGCGCTCCAGGT AGCCCGGCAGGTTCTCCTACTTCCACTGAGGAAGGTACT TCTACCGAACCTTCTGAGGGTAGCGCACCA | 387 |
| LCW04 02_015_ GFP-N_E08.ab1 | GSEPATSGSETP GSPAGSPTSTEE GTSESATPESGP | 388 | GGTAGCGAACCGGCTACTTCCGGCTCTGAGACTCCAGGT AGCCCTGCTGGCTCTCCGACCTCTACCGAAGAAGGTACC TCTGAAAGCGCTACCCCTGAGTCTGGCCCA | 389 |
| LCW04 02_016_ GFP-N_F08.ab1 | GTSTEPSEGSAP GTSESATPESGP GTSESATPESGP | 390 | GGTACTTCTACCGAACCTTCCGAGGGCAGCGCACCAGGT ACTTCTGAAAGCGCTACCCCTGAGTCCGGCCCAGGTACT TCTGAAAGCGCTACTCCTGAATCCGGTCCA | 391 |
| LCW04 02_020_ GFP-N_G08.ab1 | GTSTEPSEGSAP GSEPATSGSETP GSPAGSPTSTEE | 392 | GGTACTTCTACTGAACCGTCTGAAGGCAGCGCACCAGGT AGCGAACCGGCTACTTCCGGTTCTGAAACCCAGGTAGC CCAGCAGGTTCTCCAACTTCTACTGAAGAA | 393 |
| LCW04 02_023_ GFP-N_A09.ab1 | GSPAGSPTSTEE GTSESATPESGP GSEPATSGSETP | 394 | GGTAGCCCTGCTGGCTCTCCAACCTCCACCGAAGAAGGT ACCTCTGAAAGCGCAACCCCTGAATCCGGCCCAGGTAGC GAACCGGCAACCTCCGGTTCTGAAACCCCA | 395 |
| LCW04 02_024_ GFP-N_B09.ab1 | GTSESATPESGP GSPAGSPTSTEE GSPAGSPTSTEE | 396 | GGTACTTCTGAAAGCGCTACTCCTGAGTCCGGCCCAGGT AGCCCGGCTGGCTCTCCGACTTCCACCGAGGAAGGTAGC CCGGCTGGCTCTCCAACTTCTACTGAAGAA | 397 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| LCW04 02_025_ GFP-N_C09.ab1 | GTSTEPSEGSAP GTSESATPESGP GTSTEPSEGSAP | 398 | GGTACCTCTACTGAACCTTCTGAGGGCAGCGCTCCAGGT ACTTCTGAAAGCGCTACCCCGGAGTCCGGTCCAGGTACT TCTACTGAACCGTCCGAAGGTAGCGCACCA | 399 |
| LCW04 02_026_ GFP-N_D09.ab1 | GSPAGSPTSTEE GTSTEPSEGSAP GSEPATSGSETP | 400 | GGTAGCCCGGCAGGCTCTCCGACTTCCACCGAGGAAGGT ACCTCTACTGAACCTTCTGAGGGTAGCGCTCCAGGTAGC GAACCGGCAACCTCTGGCTCTGAAACCCCA | 401 |
| LCW04 02_027_ GFP-N_E09.ab1 | GSPAGSPTSTEE GTSTEPSEGSAP GTSTEPSEGSAP | 402 | GGTAGCCCAGCAGGCTCTCCGACTTCCACTGAGGAAGGT ACTTCTACTGAACCTTCCGAAGGCAGCGCACCAGGTACC TCTACTGAACCTTCTGAGGGCAGCGCTCCA | 403 |
| LCW04 02_032_ GFP-N_H09.ab1 | GSEPATSGSETP GTSESATPESGP GSPAGSPTSTEE | 404 | GGTAGCGAACCTGCTACCTCCGGTTCTGAAACCCCAGGT ACCTCTGAAAGCGCAACTCCGGAGTCTGGTCCAGGTAGC CCTGCAGGTTCTCCTACCTCCACTGAGGAA | 405 |
| LCW04 02_034_ GFP-N_A10.ab1 | GTSESATPESGP GTSTEPSEGSAP GTSTEPSEGSAP | 406 | GGTACCTCTGAAAGCGCTACTCCGGAGTCTGGCCCAGGT ACCTCTACTGAACCGTCTGAGGGTAGCGCTCCAGGTACT TCTACTGAACCGTCCGAAGGTAGCGCACCA | 407 |
| LCW04 02_036_ GFP-N_C10.ab1 | GSPAGSPTSTEE GTSTEPSEGSAP GTSTEPSEGSAP | 408 | GGTAGCCCCGGCTGGTTCTCCGACTTCCACCGAGGAAGGT ACCTCTACTGAACCTTCTGAGGGTAGCGCTCCAGGTACC TCTACTGAACCTTCCGAAGGCAGCGCTCCA | 409 |
| LCW04 02_039_ GFP-N_E10.ab1 | GTSTEPSEGSAP GTSTEPSEGSAP GTSTEPSEGSAP | 410 | GGTACTTCTACCGAACCGTCCGAGGGCAGCGCTCCAGGT ACTTCTACTGAACCTTCTGAAGGCAGCGCTCCAGGTACT TCTACTGAACCTTCCGAAGGTAGCGCACCA | 411 |
| LCW04 02_040_ GFP-N_F10.ab1 | GSEPATSGSETP GTSESATPESGP GTSTEPSEGSAP | 412 | GGTAGCGAACCTGCAACCTCTGGCTCTGAAACCCCAGGT ACCTCTGAAAGCGCTACTCCTGAATCTGGCCCAGGTACT TCTACTGAACCGTCCGAGGGCAGCGCACCA | 413 |
| LCW04 02_041_ GFP-N_G10.ab1 | GTSTEPSEGSAP GSPAGSPTSTEE GTSTEPSEGSAP | 414 | GGTACTTCTACCGAACCGTCCGAGGGTAGCGCACCAGGT AGCCCAGCAGGTTCTCCTACCTCCACCGAGGAAGGTACT TCTACCGAACCGTCCGAGGGTAGCGCACCA | 415 |
| LCW04 02_050_ GFP-N_A11.ab1 | GSEPATSGSETP GTSESATPESGP GSEPATSGSETP | 416 | GGTAGCGAACCGGCAACCTCCGGCTCTGAAACTCCAGGT ACTTCTGAAAGCGCTACTCCGGAATCCGGCCCAGGTAGC GAACCGGCTACTTCCGGCTCTGAAACCCCA | 417 |
| LCW04 02_051_ GFP-N_B11.ab1 | GSEPATSGSETP GTSESATPESGP GSEPATSGSETP | 418 | GGTAGCGAACCGGCAACTTCCGGCTCTGAAACCCCAGGT ACTTCTGAAAGCGCTACTCCTGAGTCTGGCCCAGGTAGC GAACCTGCTACCTCTGGCTCTGAAACCCCA | 419 |
| LCW04 02_059_ GFP-N_E11.ab1 | GSEPATSGSETP GSEPATSGSETP GTSTEPSEGSAP | 420 | GGTAGCGAACCGGCAACCTCTGGCTCTGAAACTCCAGGT AGCGAACCTGCAACCTCCGGCTCTGAAACCCCAGGTACT TCTACTGAACCTTCTGAGGGCAGCGCACCA | 421 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| LCW04 02_060_ GFP-N_F11.ab1 | GTSESATPESGP GSEPATSGSETP GSEPATSGSETP | 422 | GGTACTTCTGAAAGCGCTACCCCGGAATCTGGCCCAGGT AGCGAACCGGCTACTTCTGGTTCTGAAACCCCAGGTAGC GAACCGGCTACCTCCGGTTCTGAAACTCCA | 423 |
| LCW04 02_061_ GFP-N_G11.ab1 | GTSTEPSEGSAP GTSTEPSEGSAP GTSESATPESGP | 424 | GGTACCTCTACTGAACCTTCCGAAGGCAGCGCTCCAGGT ACCTCTACCGAACCGTCCGAGGGCAGCGCACCAGGTACT TCTGAAAGCGCAACCCCTGAATCCGGTCCA | 425 |
| LCW04 02_065_ GFP-N_A12.ab1 | GSEPATSGSETP GTSESATPESGP GTSESATPESGP | 426 | GGTAGCGAACCGGCAACCTCTGGCTCTGAAACCCCAGGT ACCTCTGAAAGCGCTACTCCGGAATCTGGTCCAGGTACT TCTGAAAGCGCTACTCCGGAATCCGGTCCA | 427 |
| LCW04 02_066_ GFP-N_B12.ab1 | GSEPATSGSETP GSEPATSGSETP GTSTEPSEGSAP | 428 | GGTAGCGAACCTGCTACCTCCGGCTCTGAAACTCCAGGT AGCGAACCGGCTACTTCCGGTTCTGAAACTCCAGGTACC TCTACCGAACCTTCCGAAGGCAGCGCACCA | 429 |
| LCW04 02_067_ GFP-N_C12.ab1 | GSEPATSGSETP GTSTEPSEGSAP GSEPATSGSETP | 430 | GGTAGCGAACCTGCTACTTCTGGTTCTGAAACTCCAGGT ACTTCTACCGAACCGTCCGAGGGTAGCGCTCCAGGTAGC GAACCTGCTACTTCTGGTTCTGAAACTCCA | 431 |
| LCW04 02_069_ GFP-N_D12.ab1 | GTSTEPSEGSAP GTSTEPSEGSAP GSEPATSGSETP | 432 | GGTACCTCTACCGAACCGTCCGAGGGTAGCGCACCAGGT ACCTCTACTGAACCGTCTGAGGGTAGCGCTCCAGGTAGC GAACCGGCAACCTCCGGTTCTGAAACTCCA | 433 |
| LCW04 02_073_ GFP-N_F12.ab1 | GTSTEPSEGSAP GSEPATSGSETP GSPAGSPTSTEE | 434 | GGTACTTCTACTGAACCTTCCGAAGGTAGCGCTCCAGGT AGCGAACCTGCTACTTCTGGTTCTGAAACCCCAGGTAGC CCGGCTGGCTCTCCGACCTCCACCGAGGAA | 435 |
| LCW04 02_074_ GFP-N_G12.ab1 | GSEPATSGSETP GSPAGSPTSTEE GTSESATPESGP | 436 | GGTAGCGAACCGGCTACTTCCGGCTCTGAGACTCCAGGT AGCCCAGCTGGTTCTCCAACCTCTACTGAGGAAGGTACT TCTGAAAGCGCTACCCCTGAATCTGGTCCA | 437 |
| LCW04 02_075_ GFP-N_H12.ab1 | GTSESATPESGP GSEPATSGSETP GTSESATPESGP | 438 | GGTACCTCTGAAAGCGCAACTCCTGAGTCTGGCCCAGGT AGCGAACCTGCTACCTCCGGCTCTGAGACTCCAGGTACC TCTGAAAGCGCAACCCCGGAATCTGGTCCA | 439 |

Example 3

Construction of XTEN_AF36 Segments

A codon library encoding sequences of 36 amino acid length was constructed. The sequences were designated XTEN_AF36. Its segments have the amino acid sequence [X]3 where X is a 12 mer peptide with the sequence: GSTSESPSGTAP (SEQ ID NO: 440), GTSTPESGSASP (SEQ ID NO: 441), GTSPSGESSTAP (SEQ ID NO: 442), or GSTSSTAESPGP (SEQ ID NO: 443). The insert was obtained by annealing the following pairs of phosphorylated synthetic oligonucleotide pairs:

```
                               (SEQ ID NO: 444)
AF1for:   AGGTTCTACYAGCGAATCYCCKTCTGGYACYGCWCC (SEQ ID NO: 445)
AF1rev:   ACCTGGWGCRGTRCCAGAMGGRGATTCGCTRGTAGA (SEQ ID NO: 446)
AF2for:   AGGTACYTCTACYCCKGAAAGCGGYTCYGCWTCTCC (SEQ ID NO: 447)
AF2rev:   ACCTGGAGAWGCRGARCCGCTTTCMGGRGTAGARGT (SEQ ID NO: 448)
AF3for:   AGGTACYTCYCCKAGCGGYGAATCTTCTACYGCWCC (SEQ ID NO: 449)
AF3rev:   ACCTGGWGCRGTAGAAGATTCRCCGCTMGGRGARGT
```

-continued

AF4for: AGGTTCYACYAGCTCTACYGCWGAATCTCCKGGYCC (SEQ ID NO: 450)

AF4rev: ACCTGGRCCMGGAGATTCWGCRGTAGAGCTRGTRGA (SEQ ID NO: 451)

We also annealed the phosphorylated oligonucleotide 3KpnIstopperFor: AGGTTCGTCTTCACTCGAGGGTAC (SEQ ID NO: 452) and the non-phosphorylated oligonucleotide pr_3KpnIstopperRev: CCTCGAGTGAAGACGA (SEQ ID NO: 453). The annealed oligonucleotide pairs were ligated, which resulted in a mixture of products with varying length that represents the varying number of 12 mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0403 showed green fluorescence after induction which shows that the sequence of XTEN_AF36 had been ligated in frame with the GFP gene and most sequences of XTEN_AF36 show good expression.

We screened 96 isolates from library LCW0403 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AF36 segments. The file names of the nucleotide and amino acid constructs for these segments are listed in Table 12.

TABLE 12

DNA and Amino Acid Sequences for 36-mer motifs

| File name | Amino acid sequence | SEQ ID NO: | Nucleotide sequence | SEQ ID NO: |
|---|---|---|---|---|
| LCW0403_004_GFP-N_A01.ab1 | GTSTPESGSASPGTSPSGESSTAPGTSPSGESSTAP | 454 | GGTACTTCTACTCCGGAAAGCGGTTCCGCATCTCCAGGTACTTCTCCTAGCGGTGAATCTTCTACTGCTCCAGGTACCTCTCCTAGCGGCGAATCTTCTACTGCTCCA | 455 |
| LCW0403_005_GFP-N_B01.ab1 | GTSPSGESSTAPGSTSSSTAESPGPGTSPSGESSTAP | 456 | GGTACTTCTCCGAGCGGTGAATCTTCTACCGCACCAGGTTCTACTAGCTCTACCGCTGAATCTCCGGGCCCAGGTACTTCTCCGAGCGGTGAATCTTCTACTGCTCCA | 457 |
| LCW0403_006_GFP-N_C01.ab1 | GSTSSTAESPGPGTSPSGESSTAPGTSTPESGSASP | 458 | GGTTCCACCAGCTCTACTGCTGAATCTCCTGGTCCAGGTACCTCTCCTAGCGGTGAATCTTCTACTGCTCCAGGTACTTCTACTCCTGAAAGCGGCTCTGCTTCTCCA | 459 |
| LCW0403_007_GFP-N_D01.ab1 | GSTSSTAESPGPGSTSSSTAESPGPGTSPSGESSTAP | 460 | GGTTCTACCAGCTCTACTGCAGAATCTCCTGGCCCAGGTTCCACCAGCTCTACCGCAGAATCTCCGGGTCCAGGTACTTCCCCTAGCGGTGAATCTTCTACCGCACCA | 461 |
| LCW0403_008_GFP-N_E01.ab1 | GSTSSTAESPGPGTSPSGESSTAPGTSTPESGSASP | 462 | GGTTCTACTAGCTCTACTGCTGAATCTCCTGGCCCAGGTACTTCTCCTAGCGGTGAATCTTCTACCGCTCCAGGTACCTCTACTCCGGAAAGCGGTTCTGCATCTCCA | 463 |
| LCW0403_010_GFP-N_F01.ab1 | GSTSSTAESPGPGTSTPESGSASPGSTSESPSGTAP | 464 | GGTTCTACCAGCTCTACCGCAGAATCTCCTGGTCCAGGTACCTCTACTCCGGAAAGCGGCTCTGCATCTCCAGGTTCTACTAGCGAATCTCCTTCTGGCACTGCACCA | 465 |
| LCW0403_011_GFP-N_G01.ab1 | GSTSSTAESPGPGTSTPESGSASPGTSTPESGSASP | 466 | GGTTCTACTAGCTCTACTGCAGAATCTCCTGGCCCAGGTACCTCTACTCCGGAAAGCGGCTCTGCATCTCCAGGTACTTCTACCCCTGAAAGCGGTTCTGCATCTCCA | 467 |
| LCW0403_012_GFP-N_H01.ab1 | GSTSESPSGTAPGTSPSGESSTAPGSTSESPSGTAP | 468 | GGTTCTACCAGCGAATCTCCTTCTGGCACCGCTCCAGGTACCTCTCCTAGCGGCGAATCTTCTACCGCTCCAGGTTCTACTAGCGAATCTCCTTCTGGCACTGCACCA | 469 |
| LCW0403_013_GFP-N_A02.ab1 | GSTSSTAESPGPGSTSSSTAESPGPGTSPSGESSTAP | 470 | GGTTCCACCAGCTCTACTGCAGAATCTCCGGGCCCAGGTTCTACTAGCTCTACTGCAGAATCTCCGGGTCCAGGTACTTCTCCTAGCGGCGAATCTTCTACCGCTCCA | 471 |

TABLE 12-continued

DNA and Amino Acid Sequences for 36-mer motifs

| File name | Amino acid sequence | SEQ ID NO: | Nucleotide sequence | SEQ ID NO: |
|---|---|---|---|---|
| LCW040 3_014_G FP-N_B02.ab1 | GSTSSTAESPGPG TSTPESGSASPGS TSESPSGTAP | 472 | GGTTCCACTAGCTCTACTGCAGAATCTCCTGGCCC AGGTACCTCTACCCCTGAAAGCGGCTCTGCATCTC CAGGTTCTACCAGCGAATCCCCGTCTGGCACCGCA CCA | 473 |
| LCW040 3_015_G FP-N_C02.ab1 | GSTSSTAESPGPG STSSTAESPGPGT SPSGESSTAP | 474 | GGTTCTACTAGCTCTACTGCTGAATCTCCGGGTCC AGGTTCTACCAGCTCTACTGCTGAATCTCCTGGTC CAGGTACCTCCCCGAGCGGTGAATCTTCTACTGCA CCA | 475 |
| LCW040 3_017_G FP-N_D02.ab1 | GSTSSTAESPGPG STSESPSGTAPGS TSSTAESPGP | 476 | GGTTCTACCAGCTCTACCGCTGAATCTCCTGGCCC AGGTTCTACCAGCGAATCCCCGTCTGGCACCGCAC CAGGTTCTACTAGCTCTACCGCTGAATCTCCGGGT CCA | 477 |
| LCW040 3_018_G FP-N_E02.ab1 | GSTSSTAESPGPG STSSTAESPGPGS TSSTAESPGP | 478 | GGTTCTACCAGCTCTACCGCAGAATCTCCTGGCCC AGGTTCCACTAGCTCTACCGCTGAATCTCCTGGTC CAGGTTCTACTAGCTCTACCGCTGAATCTCCTGGT CCA | 479 |
| LCW040 3_019_G FP-N_F02.ab1 | GSTSESPSGTAPG STSSTAESPGPGS TSSTAESPGP | 480 | GGTTCTACTAGCGAATCCCCTTCTGGTACTGCTCC AGGTTCCACTAGCTCTACCGCTGAATCTCCTGGCC CAGGTTCCACTAGCTCTACTGCAGAATCTCCTGGT CCA | 481 |
| LCW040 3_023_G FP-N_H02.ab1 | GSTSESPSGTAPG STSESPSGTAPGS TSESPSGTAP | 482 | GGTTCTACTAGCGAATCTCCTTCTGGTACCGCTCC AGGTTCTACCAGCGAATCCCCGTCTGGTACTGCTC CAGGTTCTACCAGCGAATCTCCTTCTGGTACTGCA CCA | 483 |
| LCW040 3_024_G FP-N_A03.ab1 | GSTSSTAESPGPG STSSTAESPGPGS TSSTAESPGP | 484 | GGTTCCACCAGCTCTACTGCTGAATCTCCTGGCCC AGGTTCTACCAGCTCTACTGCTGAATCTCCGGGCC CAGGTTCCACCAGCTCTACCGCTGAATCTCCGGGT CCA | 485 |
| LCW040 3_025_G FP-N_B03.ab1 | GSTSSTAESPGPG STSSTAESPGPGT SPSGESSTAP | 486 | GGTTCCACTAGCTCTACCGCAGAATCTCCTGGTCC AGGTTCTACTAGCTCTACTGCTGAATCTCCGGGTC CAGGTACCTCCCCTAGCGGCGAATCTTCTACCGCT CCA | 487 |
| LCW040 3_028_G FP-N_D03.ab1 | GSSPSASTGTGPG SSTPSGATGSPGS STPSGATGSP | 488 | GGTTCTAGCCCTTCTGCTTCCACCGGTACCGGCCC AGGTAGCTCTACTCCGTCTGGTGCAACTGGCTCTC CAGGTAGCTCTACTCCGTCTGGTGCAACCGGCTCC CCA | 489 |
| LCW040 3_029_G FP-N_E03.ab1 | GTSPSGESSTAPG TSTPESGSASPGS TSSTAESPGP | 490 | GGTACTTCCCCTAGCGGTGAATCTTCTACTGCTCC AGGTACCTCTACTCCGGAAAGCGGCTCCGCATCTC CAGGTTCTACTAGCTCTACTGCTGAATCTCCTGGT CCA | 491 |
| LCW040 3_030_G FP-N_F03.ab1 | GSTSSTAESPGPG STSSTAESPGPGT STPESGSASP | 492 | GGTTCTACTAGCTCTACCGCTGAATCTCCGGGTCC AGGTTCTACCAGCTCTACTGCAGAATCTCCTGGCC CAGGTACTTCTACTCCGGAAAGCGGTTCCGCTTCT CCA | 493 |
| LCW040 3_031_G FP-N_G03.ab1 | GTSPSGESSTAPG STSSTAESPGPGT STPESGSASP | 494 | GGTACTTCTCCTAGCGGTGAATCTTCTACCGCTCC AGGTTCTACCAGCTCTACTGCTGAATCTCCTGGCC CAGGTACTTCTACCCCGGAAAGCGGCTCCGCTTCT CCA | 495 |

TABLE 12-continued

DNA and Amino Acid Sequences for 36-mer motifs

| File name | Amino acid sequence | SEQ ID NO: | Nucleotide sequence | SEQ ID NO: |
|---|---|---|---|---|
| LCW040 3_033_G FP-N_H03.ab1 | GSTSESPSGTAPG STSSTAESPGPGS TSSTAESPGP | 496 | GGTTCTACTAGCGAATCCCCTTCTGGTACTGCACC AGGTTCTACCAGCTCTACTGCTGAATCTCCGGGCC CAGGTTCCACCAGCTCTACCGCAGAATCTCCTGGT CCA | 497 |
| LCW040 3_035_G FP-N_A04.ab1 | GSTSSTAESPGPG STSESPSGTAPGS TSSTAESPGP | 498 | GGTTCCACCAGCTCTACCGCTGAATCTCCGGGCCC AGGTTCTACCAGCGAATCCCCTTCTGGCACTGCAC CAGGTTCTACTAGCTCTACCGCAGAATCTCCGGGC CCA | 499 |
| LCW040 3_036_G FP-N_B04.ab1 | GSTSSTAESPGPG TSPSGESSTAPGT STPESGSASP | 500 | GGTTCTACCAGCTCTACTGCTGAATCTCCGGGTCC AGGTACTTCCCCGAGCGGTGAATCTTCTACTGCAC CAGGTACTTCTACTCCGGAAAGCGGTTCCGCTTCT CCA | 501 |
| LCW040 3_039_G FP-N_C04.ab1 | GSTSESPSGTAPG STSESPSGTAPGT SPSGESSTAP | 502 | GGTTCTACCAGCGAATCTCCTTCTGGCACCGCTCC AGGTTCTACTAGCGAATCCCGTCTGGTACCGCAC CAGGTACTTCTCCTAGCGGCGAATCTTCTACCGCA CCA | 503 |
| LCW040 3_041_G FP-N_D04.ab1 | GSTSESPSGTAPG STSESPSGTAPGT STPESGSASP | 504 | GGTTCTACCAGCGAATCCCCTTCTGGTACTGCTCC AGGTTCTACCAGCGAATCCCCTTCTGGCACCGCAC CAGGTACTTCTACCCCTGAAAGCGGCTCCGCTTCT CCA | 505 |
| LCW040 3_044_G FP-N_E04.ab1 | GTSTPESGSASPG STSSTAESPGPGS TSSTAESPGP | 506 | GGTACCTCTACTCCTGAAAGCGGTTCTGCATCTCC AGGTTCCACTAGCTCTACCGCAGAATCTCCGGGCC CAGGTTCTACTAGCTCTACTGCTGAATCTCCTGGC CCA | 507 |
| LCW040 3_046_G FP-N_F04.ab1 | GSTSESPSGTAPG STSESPSGTAPGT SPSGESSTAP | 508 | GGTTCTACCAGCGAATCCCCTTCTGGCACTGCACC AGGTTCTACTAGCGAATCCCCTTCTGGTACCGCAC CAGGTACTTCTCCGAGCGGCGAATCTTCTACTGCT CCA | 509 |
| LCW040 3_047_G FP-N_G04.ab1 | GSTSSTAESPGPG STSSTAESPGPGS TSESPSGTAP | 510 | GGTTCTACTAGCTCTACCGCTGAATCTCCTGGCCC AGGTTCCACTAGCTCTACCGCAGAATCTCCGGGCC CAGGTTCTACTAGCGAATCCCCTTCTGGTACCGCT CCA | 511 |
| LCW040 3_049_G FP-N_H04.ab1 | GSTSSTAESPGPG STSSTAESPGPGT STPESGSASP | 512 | GGTTCCACCAGCTCTACTGCAGAATCTCCTGGCCC AGGTTCTACTAGCTCTACCGCAGAATCTCCTGGTC CAGGTACCTCTACTCCTGAAAGCGGTTCCGCATCT CCA | 513 |
| LCW040 3_051_G FP-N_A05.ab1 | GSTSSTAESPGPG STSSTAESPGPGS TSESPSGTAP | 514 | GGTTCTACTAGCTCTACTGCTGAATCTCCGGGCCC AGGTTCTACTAGCTCTACCGCTGAATCTCCGGGTC CAGGTTCTACTAGCGAATCTCCTTCTGGTACCGCT CCA | 515 |
| LCW040 3_053_G FP-N_B05.ab1 | GTSPSGESSTAPG STSESPSGTAPGS TSSTAESPGP | 516 | GGTACCTCCCCGAGCGGTGAATCTTCTACTGCACC AGGTTCTACTAGCGAATCCCCTTCTGGTACTGCTC CAGGTTCCACCAGCTCTACTGCAGAATCTCCGGGT CCA | 517 |
| LCW040 3_054_G FP-N_C05.ab1 | GSTSESPSGTAPG TSPSGESSTAPGS TSSTAESPGP | 518 | GGTTCTACTAGCGAATCCCCGTCTGGTACTGCTCC AGGTACTTCCCCTAGCGGTGAATCTTCTACTGCTC CAGGTTCTACCAGCTCTACCGCAGAATCTCCGGGT CCA | 519 |

TABLE 12-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_057_GFP-N_D05.ab1 | GSTSSTAESPGPGSTSESPSGTAPGTSPSGESSTAP | 520 | GGTTCTACCAGCTCTACCGCTGAATCTCCTGGCCCAGGTTCTACTAGCGAATCTCCGTCTGGCACCGCACCAGGTACTTCCCCTAGCGGTGAATCTTCTACTGCACCA | 521 |
| LCW0403_058_GFP-N_E05.ab1 | GSTSESPSGTAPGSTSESPSGTAPGTSTPESGSASP | 522 | GGTTCTACTAGCGAATCTCCTTCTGGCACTGCACCAGGTTCTACCAGCGAATCTCCGTCTGGCACTGCACCAGGTACCTCTACCCCTGAAAGCGGTTCCGCTTCTCCA | 523 |
| LCW0403_060_GFP-N_F05.ab1 | GTSTPESGSASPGSTSESPSGTAPGSTSSTAESPGP | 524 | GGTACCTCTACTCCGGAAAGCGGTTCCGCATCTCCAGGTTCTACCAGCGAATCCCGTCTGGCACCGCACCAGGTTCTACTAGCTCTACTGCTGAATCTCCGGGCCCA | 525 |
| LCW0403_063_GFP-N_G05.ab1 | GSTSSTAESPGPGTSPSGESSTAPGTSPSGESSTAP | 526 | GGTTCTACTAGCTCTACTGCAGAATCTCCGGGCCCAGGTACCTCTCCTAGCGGTGAATCTTCTACCGCTCCAGGTACTTCTCCGAGCGGTGAATCTTCTACCGCTCCA | 527 |
| LCW0403_064_GFP-N_H05.ab1 | GTSPSGESSTAPGTSPSGESSTAPGTSPSGESSTAP | 528 | GGTACCTCCCCTAGCGGCGAATCTTCTACTGCTCCAGGTACCTCTCCTAGCGGCGAATCTTCTACCGCTCCAGGTACCTCCCCTAGCGGTGAATCTTCTACCGCACCA | 529 |
| LCW0403_065_GFP-N_A06.ab1 | GSTSSTAESPGPGTSTPESGSASPGSTSESPSGTAP | 530 | GGTTCCACTAGCTCTACTGCTGAATCTCCTGGCCCAGGTACTTCTACTCCGGAAAGCGGTTCCGCTTCTCCAGGTTCTACTAGCGAATCTCCGTCTGGCACCGCACCA | 531 |
| LCW0403_066_GFP-N_B06.ab1 | GSTSESPSGTAPGTSPSGESSTAPGTSPSGESSTAP | 532 | GGTTCTACTAGCGAATCTCCGTCTGGCACTGCTCCAGGTACTTCTCCTAGCGGTGAATCTTCTACCGCTCCAGGTACTTCCCCTAGCGGCGAATCTTCTACCGCTCCA | 533 |
| LCW0403_067_GFP-N_C06.ab1 | GSTSESPSGTAPGTSTPESGSASPGSTSSTAESPGP | 534 | GGTTCTACTAGCGAATCTCCTTCTGGTACCGCTCCAGGTACTTCTACCCCTGAAAGCGGCTCCGCTTCTCCAGGTTCCACTAGCTCTACCGCTGAATCTCCGGGTCCA | 535 |
| LCW0403_068_GFP-N_D06.ab1 | GSTSSTAESPGPGSTSSTAESPGPGSTSESPSGTAP | 536 | GGTTCCACTAGCTCTACTGCTGAATCTCCTGGCCCAGGTTCTACCAGCTCTACCGCTGAATCTCCTGGCCCAGGTTCTACCAGCGAATCTCCGTCTGGCACCGCA | 537 |
| LCW0403_069_GFP-N_E06.ab1 | GSTSESPSGTAPGTSTPESGSASPGTSTPESGSASP | 538 | GGTTCTACTAGCGAATCCCGTCTGGTACCGCACCAGGTACTTCTACCCCGGAAAGCGGCTCTGCTTCTCCAGGTACTTCTACCCCGGAAAGCGGCTCCGCATCTCCA | 539 |
| LCW0403_070_GFP-N_F06.ab1 | GSTSESPSGTAPGTSTPESGSASPGTSTPESGSASP | 540 | GGTTCTACTAGCGAATCCCGTCTGGTACTGCTCCAGGTACTTCTACTCCTGAAAGCGGTTCCGCTTCTCCAGGTACCTCTACTCCGGAAAGCGGTTCTGCATCTCCA | 541 |

Example 4

Construction of XTEN_AG36 Segments

A codon library encoding sequences of 36 amino acid length was constructed. The sequences were designated XTEN_AG36. Its segments have the amino acid sequence [X]$_3$ where X is a 12 mer peptide with the sequence: GTPGS-GTASSSP (SEQ ID NO: 542), GSSTPSGATGSP (SEQ ID NO: 543), GSSPSASTGTGP (SEQ ID NO: 544), or GASPGTSSTGSP (SEQ ID NO: 545). The insert was obtained by annealing the following pairs of phosphorylated synthetic oligonucleotide pairs:

```
                                       (SEQ ID NO: 546)
AG1for:    AGGTACYCCKGGYAGCGGTACYGCWTCTTCYTCTCC (SEQ ID NO: 547)
AG1rev:    ACCTGGAGARGAAGAWGCRGTACCGCTRCCMGGRGT (SEQ ID NO: 548)
AG2for:    AGGTAGCTCTACYCCKTCTGGTGCWACYGGYTCYCC (SEQ ID NO: 549)
AG2rev:    ACCTGGRGARCCRGTWGCACCAGAMGGRGTAGAGCT (SEQ ID NO: 550)
AG3for:    AGGTTCTAGCCCKTCTGCWTCYACYGGTACYGGYCC (SEQ ID NO: 551)
AG3rev:    ACCTGGRCCRGTACCRGTRGAWGCAGAMGGGCTAGA (SEQ ID NO: 552)
AG4for:    AGGTGCWTCYCCKGGYACYAGCTCTACYGGTTCTCC (SEQ ID NO: 553)
AG4rev:    ACCTGGAGAACCRGTAGAGCTRGTRCCMGGRGAWGC
```

We also annealed the phosphorylated oligonucleotide 3KpnIstopperFor: AGGTTCGTCTTCACTCGAGGGTAC (SEQ ID NO: 554) and the non-phosphorylated oligonucleotide pr_3KpnIstopperRev: CCTCGAGTGAAGACGA (SEQ ID NO: 555). The annealed oligonucleotide pairs were ligated, which resulted in a mixture of products with varying length that represents the varying number of 12 mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0404 showed green fluorescence after induction which shows that the sequence of XTEN_AG36 had been ligated in frame with the GFP gene and most sequences of XTEN_AG36 show good expression.

We screened 96 isolates from library LCW0404 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AG36 segments. The file names of the nucleotide and amino acid constructs for these segments are listed in Table 13.

TABLE 13

DNA and Amino Acid Sequences for 36-mer motifs

| File name | Amino acid sequence | SEQ ID NO: | Nucleotide sequence | SEQ ID NO: |
|---|---|---|---|---|
| LCW040 4_001_G FP-N_A07.ab 1 | GASPGTSSTGSP GTPGSGTASSSP GSSTPSGATGSP | 556 | GGTGCATCCCCGGGCACTAGCTCTACCGGTTCTCCAGGTAC TCCGGTAGCGGTACTGCTTCTTCTTCTCCAGGTAGCTCTA CTCCTTCTGGTGCTACTGGTTCTCCA | 557 |
| LCW040 4_003_G FP-N_B07.ab 1 | GSSTPSGATGSP GSSPSASTGTGP GSSTPSGATGSP | 558 | GGTAGCTCTACCCCTTCTGGTGCTACCGGCTCTCCAGGTTC TAGCCCGTCTGCTTCTACCGGTACCGGTCCAGGTAGCTCTA CCCCTTCTGGTGCTACTGGTTCTCCA | 559 |
| LCW040 4_006_G FP-N_C07.ab 1 | GASPGTSSTGSP GSSPSASTGTGP GSSTPSGATGSP | 560 | GGTGCATCTCCGGGTACTAGCTCTACCGGTTCTCCAGGTTC TAGCCCTTCTGCTTCCACTGGTACCGGCCCAGGTAGCTCTA CCCCGTCTGGTGCTACTGGTTCCCA | 561 |
| LCW040 4_007_G FP-N_D07.ab 1 | GTPGSGTASSSP GSSTPSGATGSP GASPGTSSTGSP | 562 | GGTACTCCGGGCAGCGGTACTGCTTCTTCCTCTCCAGGTAG CTCTACCCCTTCTGGTGCAACTGGTTCCCCAGGTGCATCCC TGGTACTAGCTCTACCGGTTCTCCA | 563 |
| LCW040 4_009_G FP-N_E07.ab 1 | GTPGSGTASSSP GASPGTSSTGSP GSRPSASTGTGP | 564 | GGTACCCCTGGCAGCGGTACTGCTTCTTCTTCTCCAGGTGC TTCCCCTGGTACCAGCTCTACCGGTTCTCCAGGTTCTAGAC CTTCTGCATCCACCGGTACTGGTCCA | 565 |
| LCW040 4_011_G FP-N_F07.ab 1 | GASPGTSSTGSP GSSTPSGATGSP GASPGTSSTGSP | 566 | GGTGCATCTCCTGGTACCAGCTCTACCGGTTCTCCAGGTAG CTCTACTCCTTCTGGTGCTACTGGCTCTCCAGGTGCTTCCC GGGTACCAGCTCTACCGGTTCTCCA | 567 |

TABLE 13-continued

DNA and Amino Acid Sequences for 36-mer motifs

| File name | Amino acid sequence | SEQ ID NO: | Nucleotide sequence | SEQ ID NO: |
|---|---|---|---|---|
| LCW040 4_012_G FP- N_G07.ab 1 | GTPGSGTASSSP GSSTPSGATGSP GSSTPSGATGSP | 568 | GGTACCCCGGGCAGCGGTACCGCATCTTCCTCTCCAGGTAG CTCTACCCCGTCTGGTGCTACCGGTTCCCCAGGTAGCTCTAC CCCGTCTGGTGCAACCGGCTCCCCA | 569 |
| LCW040 4_014_G FP- N_H07.ab 1 | GASPGTSSTGSP GASPGTSSTGSP GASPGTSSTGSP | 570 | GGTGCATCTCCGGGCACTAGCTCTACTGGTTCTCCAGGTGC ATCCCCTGGCACTAGCTCTACTGGTTCTCCAGGTGCTTCTCC TGGTACCAGCTCTACTGGTTCTCCA | 571 |
| LCW040 4_015_G FP- N_A08.ab 1 | GSSTPSGATGSP GSSPSASTGTGP GASPGTSSTGSP | 572 | GGTAGCTCTACTCCGTCTGGTGCAACCGGCTCCCCAGGTTC TAGCCCGTCTGCTTCCACTGGTACTGGCCCAGGTGCTTCCCC GGGCACCAGCTCTACTGGTTCTCCA | 573 |
| LCW040 4_016_G FP- N_B08.ab 1 | GSSTPSGATGSP GSSTPSGATGSP GTPGSGTASSSP | 574 | GGTAGCTCTACTCCTTCTGGTGCTACCGGTTCCCCAGGTAG CTCTACTCCTTCTGGTGCTACTGGTTCCCCAGGTACTCCGG GCAGCGGTACTGCTTCTTCCTCTCCA | 575 |
| LCW040 4_017_G FP- N_C08.ab 1 | GSSTPSGATGSP GSSTPSGATGSP GASPGTSSTGSP | 576 | GGTAGCTCTACTCCGTCTGGTGCAACCGGTTCCCCAGGTAG CTCTACTCCTTCTGGTGCTACTGGCTCCCCAGGTGCATCCCC TGGCACCAGCTCTACCGGTTCTCCA | 577 |
| LCW040 4_018_G FP- N_D08.ab 1 | GTPGSGTASSSP GSSPSASTGTGP GSSTPSGATGSP | 578 | GGTACTCCTGGTAGCGGTACCGCATCTTCCTCTCCAGGTTC TAGCCCTTCTGCATCTACCGGTACCGGTCCAGGTAGCTCTA CTCCTTCTGGTGCTACTGGCTCTCCA | 579 |
| LCW040 4_023_G FP- N_F08.ab 1 | GASPGTSSTGSP GSSPSASTGTGP GTPGSGTASSSP | 580 | GGTGCTTCCCCGGGCACTAGCTCTACCGGTTCTCCAGGTTC TAGCCCTTCTGCATCTACTGGTACTGGCCCAGGTACTCCGG GCAGCGGTACTGCTTCTTCCTCTCCA | 581 |
| LCW040 4_025_G FP- N_G08.ab 1 | GSSTPSGATGSP GSSTPSGATGSP GASPGTSSTGSP | 582 | GGTAGCTCTACTCCGTCTGGTGCTACCGGCTCTCCAGGTAG CTCTACCCCTTCTGGTGCAACCGGCTCCCCAGGTGCTTCTCC GGGTACCAGCTCTACTGGTTCTCCA | 583 |
| LCW040 4_029_G FP- N_A09.ab 1 | GTPGSGTASSSP GSSTPSGATGSP GSSPSASTGTGP | 584 | GGTACCCCTGGCAGCGGTACCGCTTCTTCCTCTCCAGGTAG CTCTACCCCGTCTGGTGCTACTGGCTCTCCAGGTTCTAGCCC GTCTGCATCTACCGGTACCGGCCCA | 585 |
| LCW040 4_030_G FP- N_B09.ab 1 | GSSTPSGATGSP GTPGSGTASSSP GTPGSGTASSSP | 586 | GGTAGCTCTACTCCTTCTGGTGCAACCGGCTCCCCAGGTAC CCCGGGCAGCGGTACCGCATCTTCCTCTCCAGGTACTCCGG GTAGCGGTACTGCTTCTTCTTCTCCA | 587 |
| LCW040 4_031_G FP- N_C09.ab 1 | GTPGSGTASSSP GSSTPSGATGSP GASPGTSSTGSP | 588 | GGTACCCCGGGTAGCGGTACTGCTTCTTCCTCTCCAGGTAG CTCTACCCCTTCTGGTGCAACCGGCTCTCCAGGTGCTTCTCC GGGCACCAGCTCTACCGGTTCTCCA | 589 |
| LCW040 4_034_G FP- N_D09.ab 1 | GSSTPSGATGSP GSSTPSGATGSP GASPGTSSTGSP | 590 | GGTAGCTCTACCCCGTCTGGTGCTACCGGCTCTCCAGGTAG CTCTACCCCGTCTGGTGCAACCGGCTCCCCAGGTGCATCCCC GGGTACTAGCTCTACCGGTTCTCCA | 591 |

TABLE 13-continued

DNA and Amino Acid Sequences for 36-mer motifs

| File name | Amino acid sequence | SEQ ID NO: | Nucleotide sequence | SEQ ID NO: |
|---|---|---|---|---|
| LCW040 4_035_G FP-N_E09.ab 1 | GASPGTSSTGSP GTPGSGTASSSP GSSTPSGATGSP | 592 | GGTGCTTCTCCGGGCACCAGCTCTACTGGTTCTCCAGGTAC CCCGGGCAGCGGTACCGCATCTTCTTCTCCAGGTAGCTCTA CTCCTTCTGGTGCAACTGGTTCTCCA | 593 |
| LCW040 4_036_G FP-N_F09.ab 1 | GSSPSASTGTGP GSSTPSGATGSP GTPGSGTASSSP | 594 | GGTTCTAGCCCCGTCTGCTTCCACCGGTACTGGCCCAGGTAG CTCTACCCCGTCTGGTGCAACTGGTTCCCCAGGTACCCCTGG TAGCGGTACCGCTTCTTCTTCTCCA | 595 |
| LCW040 4_037_G FP-N_G09.ab 1 | GASPGTSSTGSP GSSPSASTGTGP GSSTPSGATGSP | 596 | GGTGCTTCTCCGGGCACCAGCTCTACTGGTTCTCCAGGTTC TAGCCCTTCTGCATCCACCGGTACCGGTCCAGGTAGCTCTA CCCCTTCTGGTGCAACCGGCTCTCCA | 597 |
| LCW040 4_040_G FP-N_H09.ab 1 | GASPGTSSTGSP GSSTPSGATGSP GSSTPSGATGSP | 598 | GGTGCATCCCCGGGCACCAGCTCTACCGGTTCTCCAGGTAG CTCTACCCCGTCTGGTGCTACCGGCTCTCCAGGTAGCTCTAC CCCGTCTGGTGCTACTGGCTCTCCA | 599 |
| LCW040 4_041_G FP-N_A10.ab 1 | GTPGSGTASSSP GSSTPSGATGSP GTPGSGTASSSP | 600 | GGTACCCCTGGTAGCGGTACTGCTTCTTCCTCTCCAGGTAG CTCTACTCCGTCTGGTGCTACCGGTTCTCCAGGTACCCCGG GTAGCGGTACCGCATCTTCTTCTCCA | 601 |
| LCW040 4_043_G FP-N_C10.ab 1 | GSSPSASTGTGP GSSTPSGATGSP GSSTPSGATGSP | 602 | GGTTCTAGCCCTTCTGCTTCCACCGGTACTGGCCCAGGTAG CTCTACCCCTTCTGGTGCTACCGGCTCCCCAGGTAGCTCTAC TCCTTCTGGTGCAACTGGCTCTCCA | 603 |
| LCW040 4_045_G FP-N_D10.ab 1 | GASPGTSSTGSP GSSPSASTGTGP GSSPSASTGTGP | 604 | GGTGCTTCTCCTGGCACCAGCTCTACTGGTTCTCCAGGTTC TAGCCCTTCTGCTTCTACCGGTACTGGTCCAGGTTCTAGCC CTTCTGCATCCACTGGTACTGGTCCA | 605 |
| LCW040 4_047_G FP-N_F10.ab 1 | GTPGSGTASSSP GASPGTSSTGSP GASPGTSSTGSP | 606 | GGTACTCCTGGCAGCGGTACCGCTTCTTCTTCTCCAGGTGC TTCTCCTGGTACTAGCTCTACTGGTTCTCCAGGTGCTTCTC CGGGCACTAGCTCTACTGGTTCTCCA | 607 |
| LCW040 4_048_G FP-N_G10.ab 1 | GSSTPSGATGSP GASPGTSSTGSP GSSTPSGATGSP | 608 | GGTAGCTCTACCCCGTCTGGTGCTACCGGTTCCCCAGGTGC TTCTCCTGGTACTAGCTCTACCGGTTCTCCAGGTAGCTCTA CCCCGTCTGGTGCTACTGGCTCTCCA | 609 |
| LCW040 4_049_G FP-N_H10.ab 1 | GSSTPSGATGSP GTPGSGTASSSP GSSTPSGATGSP | 610 | GGTAGCTCTACCCCGTCTGGTGCTACTGGTTCTCCAGGTAC TCCGGGCAGCGGTACTGCTTCTTCCTCTCCAGGTAGCTCTA CCCCTTCTGGTGCTACTGGCTCTCCA | 611 |
| LCW040 4_050_G FP-N_A11.ab 1 | GASPGTSSTGSP GSSPSASTGTGP GSSTPSGATGSP | 612 | GGTGCATCTCCTGGTACCAGCTCTACTGGTTCTCCAGGTTC TAGCCCTTCTGCTTCTACCGGTACCGGTCCAGGTAGCTCTA CTCCTTCTGGTGCTACCGGTTCTCCA | 613 |
| LCW040 4_051_G FP-N_B11.ab 1 | GSSTPSGATGSP GSSTPSGATGSP GSSTPSGATGSP | 614 | GGTAGCTCTACCCCGTCTGGTGCTACTGGCTCTCCAGGTAG CTCTACTCCTTCTGGTGCTACTGGTTCCCCAGGTAGCTCTA CCCCGTCTGGTGCAACTGGCTCTCCA | 615 |

TABLE 13-continued

DNA and Amino Acid Sequences for 36-mer motifs

| File name | Amino acid sequence | SEQ ID NO: | Nucleotide sequence | SEQ ID NO: |
|---|---|---|---|---|
| LCW040 4_052_G FP-N_C11.ab1 | GASPGTSSTGSP GTPGSGTASSSP GASPGTSSTGSP | 616 | GGTGCATCCCCGGGTACCAGCTCTACCGGTTCTCCAGGTAC TCCTGGCAGCGGTACTGCATCTTCCTCTCCAGGTGCTTCTCC GGGCACCAGCTCTACTGGTTCTCCA | 617 |
| LCW040 4_053_G FP-N_D11.ab1 | GSSTPSGATGSP GSSPSASTGTGP GASPGTSSTGSP | 618 | GGTAGCTCTACTCCTTCTGGTGCAACTGGTTCTCCAGGTTC TAGCCCGTCTGCATCCACTGGTACCGGTCCAGGTGCTTCCC TGGCACCAGCTCTACCGMTCTCCA | 619 |
| LCW040 4_057_G FP-N_E11.ab1 | GASPGTSSTGSP GSSTPSGATGSP GSSPSASTGTGP | 620 | GGTGCATCTCCTGGTACTAGCTCTACTGGTTCTCCAGGTAG CTCTACTCCGTCTGGTGCAACCGGCTCTCCAGGTTCTAGCCC TTCTGCATCTACCGGTACTGGTCCA | 621 |
| LCW040 4_060_G FP-N_F11.ab1 | GTPGSGTASSSP GSSTPSGATGSP GASPGTSSTGSP | 622 | GGTACTCCTGGCAGCGGTACCGCATCTTCCTCTCCAGGTAG CTCTACTCCGTCTGGTGCAACTGGTTCCCCAGGTGCTTCTCC GGGTACCAGCTCTACCGGTTCTCCA | 623 |
| LCW040 4_062_G FP-N_G11.ab1 | GSSTPSGATGSP GTPGSGTASSSP GSSTPSGATGSP | 624 | GGTAGCTCTACCCCGTCTGGTGCAACCGGCTCCCCAGGTAC TCCTGGTAGCGGTACCGCTTCTTCTTCTCCAGGTAGCTCTA CTCCGTCTGGTGCTACCGGCTCCCCA | 625 |
| LCW040 4_066_G FP-N_H11.ab1 | GSSPSASTGTGP GSSPSASTGTGP GASPGTSSTGSP | 626 | GGTTCTAGCCCTTCTGCATCCACCGGTACCGGCCCAGGTTC TAGCCCGTCTGCTTCTACCGGTACTGGTCCAGGTGCTTCTC CGGGTACTAGCTCTACTGGTTCTCCA | 627 |
| LCW040 4_067_G FP-N_A12.ab1 | GTPGSGTASSSP GSSTPSGATGSP GSNPSASTGTGP | 628 | GGTACCCCGGGTAGCGGTACCGCTTCTTCTTCTCCAGGTAG CTCTACTCCGTCTGGTGCTACCGGCTCTCCAGGTTCTAACCC TTCTGCATCCACCGGTACCGGCCCA | 629 |
| LCW040 4_068_G FP-N_B12.ab1 | GSSPSASTGTGP GSSTPSGATGSP GASPGTSSTGSP | 630 | GGTTCTAGCCCTTCTGCATCTACTGGTACTGGCCCAGGTAG CTCTACTCCTTCTGGTGCTACCGGCTCTCCAGGTGCTTCTCC GGGTACTAGCTCTACCGGTTCTCCA | 631 |
| LCW040 4_069_G FP-N_C12.ab1 | GSSTPSGATGSP GASPGTSSTGSP GTPGSGTASSSP | 632 | GGTAGCTCTACCCCTTCTGGTGCAACCGGCTCTCCAGGTGC ATCCCCGGGTACCAGCTCTACCGGTTCTCCAGGTACTCCGG GTAGCGGTACCGCTTCTTCCTCTCCA | 633 |
| LCW040 4_070_G FP-N_D12.ab1 | GSSTPSGATGSP GSSTPSGATGSP GSSTPSGATGSP | 634 | GGTAGCTCTACTCCGTCTGGTGCAACCGGTTCCCCAGGTAG CTCTACCCCTTCTGGTGCAACCGGCTCCCCAGGTAGCTCTAC CCCTTCTGGTGCAACTGGCTCTCCA | 635 |
| LCW040 4_073_G FP-N_E12.ab1 | GASPGTSSTGSP GTPGSGTASSSP GSSTPSGATGSP | 636 | GGTGCTTCTCCTGGCACTAGCTCTACCGGTTCTCCAGGTAC CCCTGGTAGCGGTACCGCATCTTCCTCTCCAGGTAGCTCTA CTCCTTCTGGTGCTACTGGTTCCCCA | 637 |
| LCW040 4_075_G FP-N_F12.ab1 | GSSTPSGATGSP GSSPSASTGTGP GSSPSASTGTGP | 638 | GGTAGCTCTACCCCGTCTGGTGCTACTGGCTCCCCAGGTTC TAGCCCTTCTGCATCCACCGGTACCGGTCCAGGTTCTAGCC CGTCTGCATCTACTGGTACTGGTCCA | 639 |

TABLE 13-continued

DNA and Amino Acid Sequences for 36-mer motifs

| File name | Amino acid sequence | SEQ ID NO: | Nucleotide sequence | SEQ ID NO: |
|---|---|---|---|---|
| LCW040 4_080_G FP- N_G12.ab 1 | GASPGTSSTGSP GSSPSASTGTGP GSSPSASTGTGP | 640 | GGTGCTTCCCCGGGCACCAGCTCTACTGGTTCTCCAGGTTC TAGCCCGTCTGCTTCTACTGGTACTGGTCCAGGTTCTAGCC CTTCTGCTTCCACTGGTACTGGTCCA | 641 |
| LCW040 4_081_G FP- N_H12.a b1 | GASPGTSSTGSP GSSPSASTGTGP GTPGSGTASSSP | 642 | GGTGCTTCCCCGGGTACCAGCTCTACCGGTTCTCCAGGTTC TAGCCCTTCTGCTTCTACCGGTACCGGTCCAGGTACCCCTG GCAGCGGTACCGCATCTTCCTCTCCA | 643 |

Example 5

Construction of XTEN_AE864

XTEN_AE864 was constructed from serial dimerization of XTEN_AE36 to AE72, 144, 288, 576 and 864. A collection of XTEN_AE72 segments was constructed from 37 different segments of XTEN_AE36. Cultures of E. coli harboring all 37 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AE72.

This library of XTEN_AE72 segments was designated LCW0406. All clones from LCW0406 were combined and dimerized again using the same process as described above yielding library LCW0410 of XTEN_AE144. All clones from LCW0410 were combined and dimerized again using the same process as described above yielding library LCW0414 of XTEN_AE288. Two isolates LCW0414.001 and LCW0414.002 were randomly picked from the library and sequenced to verify the identities. All clones from LCW0414 were combined and dimerized again using the same process as described above yielding library LCW0418 of XTEN_AE576. We screened 96 isolates from library LCW0418 for high level of GFP fluorescence. 8 isolates with right sizes of inserts by PCR and strong fluorescence were sequenced and 2 isolates (LCW0418.018 and LCW0418.052) were chosen for future use based on sequencing and expression data.

The specific clone pCW0432 of XTEN_AE864 was constructed by combining LCW0418.018 of XTEN_AE576 and LCW0414.002 of XTEN_AE288 using the same dimerization process as described above.

Example 6

Construction of XTEN_AM144

A collection of XTEN_AM144 segments was constructed starting from 37 different segments of XTEN_AE36, 44 segments of XTEN_AF36, and 44 segments of XTEN_AG36.

Cultures of E. coli harboring all 125 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AM72.

This library of XTEN_AM72 segments was designated LCW0461. All clones from LCW0461 were combined and dimerized again using the same process as described above yielding library LCW0462. 1512 Isolates from library LCW0462 were screened for protein expression. Individual colonies were transferred into 96 well plates and cultured overnight as starter cultures. These starter cultures were diluted into fresh autoinduction medium and cultured for 20-30 h. Expression was measured using a fluorescence plate reader with excitation at 395 nm and emission at 510 nm. 192 isolates showed high level expression and were submitted to DNA sequencing. Most clones in library LCW0462 showed good expression and similar physicochemical properties suggesting that most combinations of XTEN_AM36 segments yield useful XTEN sequences. 30 isolates from LCW0462 were chosen as a preferred collection of XTEN_AM144 segments for the construction of multifunctional proteins that contain multiple XTEN segments. The file names of the nucleotide and amino acid constructs for these segments are listed in Table 14.

TABLE 14

DNA and amino acid sequences for AM144 segments

| Clone | Sequence Trimmed | SEQ ID NO: | Protein Sequence | SEQ ID NO: |
|---|---|---|---|---|
| LCW4 62_r1 | GGTACCCCGGGCAGCGGTACCGCATCTTCCTCTCCA GGTAGCTCTACCCCGTCTGGTGCTACCGGTTCCCCA GGTAGCTCTACCCCGTCTGGTGCAACCGGCTCCCCA GGTAGCCCGGCTGGCTCTCCTACCTCTACTGAGGAA GGTACTTCTGAAAGCGCTACTCCTGAGTCTGGTCCA GGTACCTCTACTGAACCGTCCGAAGGTAGCGCTCCA | 644 | GTPGSGTASSSPGSSTPSGA TGSPGSSTPSGATGSPGSPA GSPTSTEEGTSESATPESGP GTSTEPSEGSAPGSSPSAST GTGPGSSPSASTGTGPGASP GTSSTGSPGTSTEPSEGSAP | 645 |

TABLE 14-continued

DNA and amino acid sequences for AM144 segments

| Clone | Sequence Trimmed | SEQ ID NO: | Protein Sequence | SEQ ID NO: |
|---|---|---|---|---|
| | GGTTCTAGCCCTTCTGCATCCACCGGTACCGGCCCA<br>GGTTCTAGCCCGTCTGCTTCTACCGGTACTGGTCCA<br>GGTGCTTCTCCGGGTACTAGCTCTACTGGTTCTCCA<br>GGTACCTCTACCGAACCGTCCGAGGGTAGCGCACCA<br>GGTACCTCTACTGAACCGTCTGAGGGTAGCGCTCCA<br>GGTAGCGAACCGGCAACCTCCGGTTCTGAAACTCCA | | GTSTEPSEGSAPGSEPATSG<br>SETP | |
| LCW4<br>62_r5 | GGTTCTACCAGCGAATCCCCTTCTGGCACTGCACCA<br>GGTTCTACTAGCGAATCCCCTTCTGGTACCGCACCA<br>GGTACTTCTCCGAGCGGCGAATCTTCTACTGCTCCA<br>GGTACCTCTACTGAACCTTCCGAAGGCAGCGCTCCA<br>GGTACCTCTACCGAACCGTCCGAGGGCAGCGCACCA<br>GGTACTTCTGAAAGCGCAACCCCTGAATCCGGTCCA<br>GGTGCATCTCCTGGTACCAGCTCTACCGGTTCTCCA<br>GGTAGCTCTACTCCTTCTGGTGCTACTGGCTCTCCA<br>GGTGCTTCCCCGGGTACCAGCTCTACCGGTTCTCCA<br>GGTTCTACTAGCGAATCTCCTTCTGGCACTGCACCA<br>GGTTCTACCAGCGAATCTCCGTCTGGCACTGCACCA<br>GGTACCTCTACCCCTGAAAGCGGTTCCGCTTCTCCA | 646 | GSTSESPSGTAPGSTSESPS<br>GTAPGSTSPSGESSTAPGTST<br>EPSEGSAPGTSTEPSEGSAP<br>GTSESATPESGPGASPGTSS<br>TGSPGSSTPSGATGSPGASP<br>GTSSTGSPGSTSESPSGTAP<br>GSTSESPSGTAPGTSTPESG<br>SASP | 647 |
| LCW4<br>62_r9 | GGTACTTCTACCGAACCTTCCGAGGGCAGCGCACCA<br>GGTACTTCTGAAAGCGCTACCCCTGAGTCCGGCCCA<br>GGTACTTCTGAAAGCGCTACTCCTGAATCCGGTCCA<br>GGTACCTCTACTGAACCTTCTGAGGGCAGCGCTCCA<br>GGTACTTCTGAAAGCGCTACCCCGGAGTCCGGTCCA<br>GGTACTTCTACTGAACCGTCCGAAGGTAGCGCACCA<br>GGTACTTCTACTGAACCTTCCGAAGGTAGCGCTCCA<br>GGTAGCGAACCTGCTACTTCTGGTTCTGAAACCCCA<br>GGTAGCCCGGCTGGCTCTCCGACCTCCACCGAGGAA<br>GGTGCTTCTCCTGGCACCAGCTCTACTGGTTCTCCA<br>GGTTCTAGCCCTTCTGCTTCTACCGGTACTGGTCCA<br>GGTTCTAGCCCTTCTGCATCCACTGGTACTGGTCCA | 648 | GTSTEPSEGSAPGTSESATP<br>ESGPGTSESATPESGPGTST<br>EPSEGSAPGTSESATPESGP<br>GTSTEPSEGSAPGTSTEPSE<br>GSAPGSEPATSGSETPGSPA<br>GSPTSTEEGASPGTSSTGSP<br>GSSPSASTGTGPGSSPSAST<br>GTGP | 649 |
| LCW4<br>62_r10 | GGTAGCGAACCGGCAACCTCTGGCTCTGAAACCCCA<br>GGTACCTCTGAAAGCGCTCCGGAATCTGGTCCA<br>GGTACTTCTGAAAGCGCTACTCCGGAATCCGGTCCA<br>GGTTCTACCAGCGAATCTCCTTCTGGCACCGCTCCA<br>GGTTCTACTAGCGAATCCCCGTCTGGTACCGCACCA<br>GGTACTTCTCCTAGCGGCGAATCTTCTACCGCACCA<br>GGTGCATCTCCGGGTACTAGCTCTACCGGTTCTCCA<br>GGTTCTAGCCCTTCTGCTTCCACTGGTACCGGCCCA<br>GGTAGCTCTACCCCGTCTGGTGCTACTGGTTCCCCA<br>GGTAGCTCTACTCCGTCTGGTGCAACCGGTTCCCCA<br>GGTAGCTCTACTCCTTCTGGTGCTACTGGCTCCCCA<br>GGTGCATCCCCTGGCACCAGCTCTACCGGTTCTCCA | 650 | GSEPATSGSETPGTSESATP<br>ESGPGTSESATPESGPGSTS<br>ESPSGTAPGSTSESPSGTAP<br>GTSPSGESSTAPGASPGTSS<br>TGSPGSSPSASTGTGPGSST<br>PSGATGSPGSSTPSGATGSP<br>GSSTPSGATGSPGASPGTSS<br>TGSP | 651 |
| LCW4<br>62_r15 | GGTGCTTCTCCGGGCACCAGCTCTACTGGTTCTCCA<br>GGTTCTAGCCCTTCTGCATCCACCGGTACCGGCCCA<br>GGTAGCTCTACCCCTTCTGGTGCAACCGGTCTCCA<br>GGTACTTCTGAAAGCGCTACCCCGGAATCTGGCCCA<br>GGTAGCGAACCGGCTACTTCTGGTTCTGAAACCCCA<br>GGTAGCGAACCGGCTACCTCCGGTTCTGAAACTCCA<br>GGTACTTCTGAAAGCGCTACTCCGGAGTCCGGTCCA<br>GGTACCTCTACCGAACCGTCCGAAGGCAGCGCTCCA<br>GGTACTTCTACTGAACCTTCTGAGGGTAGCGCTCCA<br>GGTACCTCTACCGAACCGTCCGAGGGTAGCGCACCA<br>GGTACCTCTACTGAACCGTCTGAGGGTAGCGCTCCA<br>GGTAGCGAACCGGCAACCTCCGGTTCTGAAACTCCA | 652 | GASPGTSSTGSPGSSPSAST<br>GTGPGSSTPSGATGSPGTSE<br>SATPESGPGSEPATSGSETP<br>GSEPATSGSETPGTSESATP<br>ESGPGTSTEPSEGSAPGTST<br>EPSEGSAPGTSTEPSEGSAP<br>GTSTEPSEGSAPGSEPATSG<br>SETP | 653 |
| LCW4<br>62_r16 | GGTACCTCTACCGAACCTTCCGAAGGTAGCGCTCCA<br>GGTAGCCCGGCAGGTTCTCCTACTTCCACTGAGGAA<br>GGTACTTCTACCGAACCTTCTGAGGGTAGCGCACCA<br>GGTACCTCTGAAAGCGCAACTCCTGAGTCTGGCCCA<br>GGTAGCGAACCTGCTACCTCCGGCTCTGAGACTCCA<br>GGTACTCTGAAAGCGCAACCCCGGAATCTGGTCCA<br>GGTAGCCCGGCTGGCTCTCCTACCTCTACTGAGGAA<br>GGTACTTCTGAAAGCGCTACTCCTGAGTCTGGTCCA<br>GGTACCTCTACTGAACCGTCCGAAGGTAGCGCTCCA<br>GGTAGCGAACCTGCTACTTCTGGTTCTGAAACTCCA<br>GGTACTTCTACCGAACCGTCCGAGGGTAGCGCTCCA<br>GGTAGCGAACCTGCTACTTCTGGTTCTGAAACTCCA | 654 | GTSTEPSEGSAPGSPAGSPT<br>STEEGTSTEPSEGSAPGTSE<br>SATPESGPGSEPATSGSETP<br>GTSESATPESGPGSPAGSPT<br>STEEGTSESATPESGPGTST<br>EPSEGSAPGSEPATSGSETP<br>GTSTEPSEGSAPGSEPATSG<br>SETP | 655 |

TABLE 14-continued

DNA and amino acid sequences for AM144 segments

| Clone | Sequence Trimmed | SEQ ID NO: | Protein Sequence | SEQ ID NO: |
|---|---|---|---|---|
| LCW4 62_r20 | GGTACTTCTACCGAACCGTCCGAAGGCAGCGCTCCA<br>GGTACCTCTACTGAACCTTCCGAGGGCAGCGCTCCA<br>GGTACCTCTACCGAACCTTCTGAAGGTAGCGCACCA<br>GGTACTTCTACCGAACCGTCCGAAGGCAGCGCTCCA<br>GGTACCTCTACTGAACCTTCCGAGGGCAGCGCTCCA<br>GGTACCTCTACCGAACCTTCTGAAGGTAGCGCACCA<br>GGTACTTCTACCGAACCTTCCGAGGGCAGCGCACCA<br>GGTACTTCTGAAAGCGCTACCCCTGAGTCCGGCCCA<br>GGTACTTCTGAAAGCGCTACTCCTGAATCCGGTCCA<br>GGTACTTCTACTGAACCTTCCGAAGGTAGCGCTCCA<br>GGTAGCGAACCTGCTACTTCTGGITCTGAAACCCCA<br>GGTAGCCCGGCTGGCTCTCCGACCTCCACCGAGGAA | 656 | GTSTEPSEGSAPGTSTEPSE<br>GSAPGTSTEPSEGSAPGTST<br>EPSEGSAPGTSTEPSEGSAP<br>GTSTEPSEGSAPGTSTEPSE<br>GSAPGTSESATPESGPGTSE<br>SATPESGPGTSTEPSEGSAP<br>GSEPATSGSETPGSPAGSPT<br>STEE | 657 |
| LCW4 62_r23 | GGTACTTCTACCGAACCGTCCGAGGGCAGCGCTCCA<br>GGTACTTCTACTGAACCTTCTGAAGGCAGCGCTCCA<br>GGTACTTCTACTGAACCTTCCGAAGGTAGCGCACCA<br>GGITCTACCAGCGAATCCCCTTCTGGTACTGCTCCA<br>GGTTCTACCAGCGAATCCCCTTCTGGCACCGCACCA<br>GGTACTTCTACCCCTGAAAGCGGCTCCGCTTCTCCA<br>GGTAGCGAACCTGCAACCTCTGGCTCTGAAACCCCA<br>GGTACCTCTGAAAGCGCTACTCCTGAATCTGGCCCA<br>GGTACTTCTACTGAACCGTCCGAGGGCAGCGCACCA<br>GGTACTTCTACTGAACCGTCTGAAGGTAGCGCACCA<br>GGTACTTCTGAAAGCGCAACCCCGGAATCCGGCCCA<br>GGTACCTCTGAAAGCGCAACCCCGGAGTCCGGCCCA | 658 | GTSTEPSEGSAPGTSTEPSE<br>GSAPGTSTEPSEGSAPGSTS<br>ESPSGTAPGSTSESPSGTAP<br>GTSTPESGSASPGSEPATSG<br>SETPGTSESATPESGPGTST<br>EPSEGSAPGTSTEPSEGSAP<br>GTSESATPESGPGTSESATP<br>ESGP | 659 |
| LCW4 62_r24 | GGTAGCTCTACCCCTTCTGGTGCTACCGGCTCTCCA<br>GGITCTAGCCCGTCTGCTTCTACCGGTACCGGTCCA<br>GGTAGCTCTACCCCTTCTGGTGCTACTGGTTCTCCA<br>GGTAGCCCTGCTGGCTCTCCGACTTCTACTGAGGAA<br>GGTAGCCCGGCTGGITCTCCGACTICTACTGAGGAA<br>GGTACTTCTACCGAACCTTCCGAAGGTAGCGCTCCA<br>GGTGCTTCCCCGGGCACTAGCTCTACCGGTTCTCCA<br>GGTTCTAGCCCTTCTGCATCTACTGGTACTGGCCCA<br>GGTACTCCGGGCAGCGGTACTGCTTCTTCCTCTCCA<br>GGITCTACTAGCTCTACTGCTGAATCTCCTGGCCCA<br>GGTACTTCTCCTAGCGGTGAATCTTCTACCGCTCCA<br>GGTACCTCTACTCCGGAAAGCGGTTCTGCATCTCCA | 660 | GSSTPSGATGSPGSSPSAST<br>GTGPGSSTPSGATGSPGSPA<br>GSPTSTEEGSPAGSPTSTEE<br>GTSTEPSEGSAPGASPGTSS<br>TGSPGSSPSASTGTGPGTPG<br>SGTASSSPGSTSSTAESPGP<br>GTSPSGESSTAPGTSTPESG<br>SASP | 661 |
| LCW4 62_r27 | GGTACCTCTACTGAACCTTCTGAGGGCAGCGCTCCA<br>GGTACTTCTGAAAGCGCTACCCCGGAGTCCGGTCCA<br>GGTACTTCTACTGAACCGTCCGAAGGTAGCGCACCA<br>GGTACTTCTACTGAACCGTCTGAAGGTAGCGCACCA<br>GGTACTTCTGAAAGCGCAACCCCGGAATCCGGTCCA<br>GGTACCTCTGAAAGCGCAACCCCGGAGTCCGGCCCA<br>GGTACTCCTGGCAGCGGTACCGCTTCTTCTTCTCCA<br>GGTGCTTCTCCTGGTACTAGCTCTACTGGTTCTCCA<br>GGTGCTTCTCCGGGCACTAGCTCTACTGGTTCTCCA<br>GGTAGCCCTGCTGGCTCTCCGACTTCTACTGAGGAA<br>GGTAGCCCGGCTGGTTCTCCGACTTCTACTGAGGAA<br>GGTACTTCTACCGAACCTTCCGAAGGTAGCGCTCCA | 662 | GTSTEPSEGSAPGTSESATP<br>ESGPGTSTEPSEGSAPGTST<br>EPSEGSAPGTSESATPESGP<br>GTSESATPESGPGTPGSGTA<br>SSSPGASPGTSSTGSPGASP<br>GTSSTGSPGSPAGSPTSTEE<br>GSPAGSPTSTEEGTSTEPSE<br>GSAP | 663 |
| LCW4 62_r28 | GGTAGCCCAGCAGGCTCTCCGACTTCCACTGAGGAA<br>GGTACTTCTACTGAACCTTCCGAAGGCAGCGCACCA<br>GGTACCTCTACTGAACCTTCTGAGGGCAGCGCTCCA<br>GGTACCTCTACCGAACCGTCTGAAGGTAGCGCACCA<br>GGTACCTCTGAAAGCGCAACTCCTGAGTCCGGTCCA<br>GGTACTTCTGAAAGCGCAACCCCGGAGTCTGGCCCA<br>GGTACCCGGGTAGCGGTACTGCTTCTTCCTCTCCA<br>GGTAGCTCTACCCCTTCTGGTGCAACCGGCTCTCCA<br>GGTGCTTCTCCGGGCACCAGCTCTACCGGTTCTCCA<br>GGTACCTCTACTGAACCTTCTGAGGGCAGCGCTCCA<br>GGTACTTCTGAAAGCGCTACCCCGGAGTCCGGTCCA<br>GGTACTTCTACTGAACCGTCCGAAGGTAGCGCACCA | 664 | GSPAGSPTSTEEGTSTEPSE<br>GSAPGTSTEPSEGSAPGTST<br>EPSEGSAPGTSESATPESGP<br>GTSESATPESGPGTPGSGTA<br>SSSPGSSTPSGATGSPGASP<br>GTSSTGSPGTSTEPSEGSAP<br>GTSESATPESGPGTSTEPSE<br>GSAP | 665 |

TABLE 14-continued

DNA and amino acid sequences for AM144 segments

| Clone | Sequence Trimmed | SEQ ID NO: | Protein Sequence | SEQ ID NO: |
|---|---|---|---|---|
| LCW4 62_r38 | GGTAGCGAACCGGCAACCTCCGGCTCTGAAACTCCA<br>GGTACTTCTGAAAGCGCTACTCCGGAATCCGGCCCA<br>GGTAGCGAACCGGCTACTTCCGGCTCTGAAACCCCA<br>GGTAGCTCTACCCCGTCTGGTGCAACCGGCTCCCCA<br>GGTACTCCTGGTAGCGGTACCGCTTCTTCTTCTCCA<br>GGTAGCTCTACTCCGTCTGGTGCTACCGGCTCCCCA<br>GGTGCATCTCCTGGTACCAGCTCTACCGGTTCTCCA<br>GGTAGCTCTACTCCTTCTGGTGCTACTGGCTCTCCA<br>GGTGCTTCCCCGGGTACCAGCTCTACCGGTTCTCCA<br>GGTAGCGAACCTGCTACTTCTGGTTCTGAAACTCCA<br>GGTACTTCTACCGAACCGTCCGAGGGTAGCGCTCCA<br>GGTAGCGAACCTGCTACTTCTGGTTCTGAAACTCCA | 666 | GSEPATSGSETPGTSESATP<br>ESGPGSEPATSGSETPGSST<br>PSGATGSPGTPGSGTASSSP<br>GSSTPSGATGSPGASPGTSS<br>TGSPGSSTPSGATGSPGASP<br>GTSSTGSPGSEPATSGSETP<br>GTSTEPSEGSAPGSEPATSG<br>SETP | 667 |
| LCW4 62_r39 | GGTACCTCTACTGAACCTTCCGAAGGCAGCGCTCCA<br>GGTACCTCTACCGAACCGTCCGAGGGCAGCGCACCA<br>GGTACTTCTGAAAGCGCAACCCCTGAATCCGGTCCA<br>GGTAGCCCTGCTGGCTCTCCGACTTCTACTGAGGAA<br>GGTAGCCCGGCTGGTTCTCCGACTTCTACTGAGGAA<br>GGTACTTCTACCGAACCTTCCGAAGGTAGCGCTCCA<br>GGTAGCCCGGCTGGTTCTCCGACTTCCACCGAGGAA<br>GGTACCTCTACTGAACCTTCTGAGGGTAGCGCTCCA<br>GGTACCTCTACTGAACCTTCCGAAGGCAGCGCTCCA<br>GGTGCTTCCCCGGGCACCAGCTCTACTGGTTCTCCA<br>GGTTCTAGCCCGTCTGCTTCTACTGGTACTGGTCCA<br>GGTTCTAGCCCTTCTGCTTCCACTGGTACTGGTCCA | 668 | GTSTEPSEGSAPGTSTEPSE<br>GSAPGTSESATPESGPGSPA<br>GSPTSTEEGSPAGSPTSTEE<br>GTSTEPSEGSAPGSPAGSPT<br>STEEGTSTEPSEGSAPGTST<br>EPSEGSAPGASPGTSSTGSP<br>GSSPSASTGTGPGSSPSAST<br>GTGP | 669 |
| LCW4 62_r41 | GGTAGCTCTACCCCGTCTGGTGCTACCGGTTCCCCA<br>GGTGCTTCTCCTGGTACTAGCTCTACCGGTTCTCCA<br>GGTAGCTCTACCCCGTCTGGTGCTACTGGCTCTCCA<br>GGTAGCCCTGCTGGCTCTCCAACCTCCACCGAAGAA<br>GGTACCTCTGAAAGCGCAACCCCTGAATCCGGCCCA<br>GGTAGCGAACCGGCAACCTCCGGTTCTGAAACCCCA<br>GGTGCATCTCCTGGTACTAGCTCTACTGGTTCTCCA<br>GGTAGCTCTACTCCGTCTGGTGCAACCGGCTCTCCA<br>GGTTCTAGCCCTTCTGCATCTACCGGTACTGGTCCA<br>GGTTCTACCAGCGAATCCCCTTCTGGTACTGCTCCA<br>GGTTCTACCAGCGAATCCCCTTCTGGCACCGCACCA<br>GGTACTTCTACCCCTGAAAGCGGCTCCGCTTCTCCA | 670 | GSSTPSGATGSPGASPGTSS<br>TGSPGSSTPSGATGSPGSPA<br>GSPTSTEEGTSESATPESGP<br>GSEPATSGSETPGASPGTSS<br>TGSPGSSTPSGATGSPGSSP<br>SASTGTGPGSTSESPSGTAP<br>GSTSESPSGTAPGTSTPESG<br>SASP | 671 |
| LCW4 62_r42 | GGTTCTACCAGCGAATCTCCTTCTGGCACCGCTCCA<br>GGTTCTACTAGCGAATCCCCGTCTGGTACCGCACCA<br>GGTACTTCTCCTAGCGGCGAATCTTCTACCGCACCA<br>GGTACCTCTGAAAGCGCTACTCCGGAGTCTGGCCCA<br>GGTACCTCTACTGAACCGTCTGAGGGTAGCGCTCCA<br>GGTACTTCTACTGAACCGTCCGAAGGTAGCGCACCA<br>GGTACCTCTACTGAACCTTCTGAGGGCAGCGCTCCA<br>GGTACTTCTGAAAGCGCTACCCCGGAGTCCGGTCCA<br>GGTACTTCTACTGAACCGTCCGAAGGTAGCGCACCA<br>GGTAGCTCTACCCCGTCTGGTGCTACCGGTTCCCCA<br>GGTGCTTCTCCTGGTACTAGCTCTACCGGTTCTCCA<br>GGTAGCTCTACCCCGTCTGGTGCTACTGGCTCTCCA | 672 | GSTSESPSGTAPGSTSESPS<br>GTAPGTSPSGESSTAPGTSE<br>SATPESGPGSTSTEPSEGSAP<br>GTSTEPSEGSAPGTSTEPSE<br>GSAPGTSESATPESGPGTST<br>EPSEGSAPGSSTPSGATGSP<br>GASPGTSSTGSPGSSTPSGA<br>TGSP | 673 |
| LCW4 62_r43 | GGTTCTACTAGCTCTACTGCAGAATCTCCGGGCCCA<br>GGTACCTCTCTAGCGGTGAATCTTCTACCGCTCCA<br>GGTACTTCTCCGAGCGGTGAATCTTCTACCGCTCCA<br>GGTTCTACTAGCTCTACCGCTGAATCTCCGGGTCCA<br>GGTTCTACCAGCTCTACTGCAGAATCTCCTGGCCCA<br>GGTACTTCTACTCCGGAAAGCGGITCCGCTTCTCCA<br>GGTACTTCTCCTAGCGGTGAATCTTCTACCGCTCCA<br>GGTTCTACCAGCTCTACTGCTGAATCTCCTGGCCCA<br>GGTACTTCTACCCCGGAAAGCGGCTCCGCTTCTCCA<br>GGTTCTACCAGCTCTACCGCTGAATCTCCTGGCCCA<br>GGTTCTACTAGCGAATCTCCGTCTGGCACCGCACCA<br>GGTACTTCCCCTAGCGGTGAATCTTCTACTGCACCA | 674 | GSTSSTAESPGPGTSPSGES<br>STAPGTSPSGESSTAPGSTS<br>STAESPGPGSTSSTAESPGP<br>GTSTPESGSASPGTSPSGES<br>STAPGSTSSTAESPGPGTST<br>PESGSASPGSTSSTAESPGP<br>GSTSESPSGTAPGTSPSGES<br>STAP | 675 |

TABLE 14-continued

DNA and amino acid sequences for AM144 segments

| Clone | Sequence Trimmed | SEQ ID NO: | Protein Sequence | SEQ ID NO: |
|---|---|---|---|---|
| LCW4 62_r45 | GGTACCTCTACTCCGGAAAGCGGTTCCGCATCTCCA<br>GGTTCTACCAGCGAATCCCCGTCTGGCACCGCACCA<br>GGTTCTACTAGCTCTACTGCTGAATCTCCGGGCCCA<br>GGTACCTCTACTGAACCTTCCGAAGGCAGCGCTCCA<br>GGTACCTCTACCGAACCGTCCGAGGGCAGCGCACCA<br>GGTACTTCTGAAAGCGCAACCCCTGAATCCGGTCCA<br>GGTACCTCTGAAAGCGCTACTCCGGAGTCTGGCCCA<br>GGTACCTCTACTGAACCGTCTGAGGGTAGCGCTCCA<br>GGTACTTCTACTGAACCGTCCGAAGGTAGCGCACCA<br>GGTACTTCTGAAAGCGCTACTCCGGAGTCCGGTCCA<br>GGTACCTCTACCGAACCGTCCGAAGGCAGCGCTCCA<br>GGTACTTCTACTGAACCTTCTGAGGGTAGCGCTCCC | 676 | GTSTPESGSASPGSTSESPS<br>GTAPGSTSSTAESPGPGTST<br>EPSEGSAPGTSTEPSEGSAP<br>GTSESATPESGPGTSESATP<br>ESGPGTSTEPSEGSAPGTST<br>EPSEGSAPGTSESATPESGP<br>GTSTEPSEGSAPGTSTEPSE<br>GSAP | 677 |
| LCW4 62_r47 | GGTACCTCTACCGAACCGTCCGAGGGTAGCGCACCA<br>GGTACCTCTACTGAACCGTCTGAGGGTAGCGCTCCA<br>GGTAGCGAACCGGCAACCTCCGGTTCTGAAACTCCA<br>GGTACTTCTACTGAACCGTCTGAAGGTAGCGCACCA<br>GGTACTTCTGAAAGCGCAACCCCGGAATCCGGCCCA<br>GGTACCTCTGAAAGCGCAACCCCGGAGTCCGGCCCA<br>GGTGCATCTCCGGGTACTAGCTCTACCGGTTCTCCA<br>GGTTCTAGCCCTTCTGCTTCCACTGGTACCGGCCCA<br>GGTAGCTCTACCCCGTCTGGTGCTACTGGTTCCCCA<br>GGTAGCTCTACTCCGTCTGGTGCAACCGGITCCCCA<br>GGTAGCTCTACTCCTTCTGGTGCTACTGGCTCCCCA<br>GGTGCATCCCTGGCACCAGCTCTACCGGTTCTCCA | 678 | GTSTEPSEGSAPGTSTEPSE<br>GSAPGSEPATSGSETPGTST<br>EPSEGSAPGTSESATPESGP<br>GTSESATPESGPGASPGTSS<br>TGSPGSSPSASTGTGPGSST<br>PSGATGSPGSSTPSGATGSP<br>GSSTPSGATGSPGASPGTSS<br>TGSP | 679 |
| LCW4 62_r54 | GGTAGCGAACCGGCAACCTCTGGCTCTGAAACTCCA<br>GGTAGCGAACCTGCAACCTCCGGCTCTGAAACCCCA<br>GGTACTTCTACTGAACCTTCTGAGGGCAGCGCACCA<br>GGTAGCGAACCTGCAACCTCTGGCTCTGAAACCCCA<br>GGTACCTCTGAAAGCGCTACTCCTGAATCTGGCCCA<br>GGTACTTCTACTGAACCGTCCGAGGGCAGCGCACCA<br>GGTAGCTCTACTCCGTCTGGTGCTACCGGCTCTCCA<br>GGTAGCTCTACCCCTTCTGGTGCAACCGGCTCCCCA<br>GGTGCTTCTCCGGGTACCAGCTCTACTGGTTCTCCA<br>GGTAGCTCTACCCCGTCTGGTGCTACCGGTTCCCCA<br>GGTGCTTCTCCTGGTACTAGCTCTACCGGTTCTCCA<br>GGTAGCTCTACCCCGTCTGGTGCTACTGGCTCTCCA | 680 | GSEPATSGSETPGSEPATSG<br>SETPGTSTEPSEGSAPGSEP<br>ATSGSETPGTSESATPESGP<br>GTSTEPSEGSAPGSSTPSGA<br>TGSPGSSTPSGATGSPGASP<br>GTSSTGSPGSSTPSGATGSP<br>GASPGTSSTGSPGSSTPSGA<br>TGSP | 681 |
| LCW4 62_r55 | GGTACTTCTACCGAACCGTCCGAGGGCAGCGCTCCA<br>GGTACTTCTACTGAACCTTCTGAAGGCAGCGCTCCA<br>GGTACTTCTACTGAACCTTCCGAAGGTAGCGCACCA<br>GGTACTTCTGAAAGCGCTACTCCGGAGTCCGGTCCA<br>GGTACCTCTACCGAACCGTCCGAAGGCAGCGCTCCA<br>GGTACTTCTACTGAACCTTCTGAGGGTAGCGCTCCA<br>GGTTCTACTAGCGAATCTCCGTCTGGCACTGCTCCA<br>GGTACTTCTCCTAGCGGTGAATCTTCTACCGCTCCA<br>GGTACTTCCCCTAGCGGCGAATCTTCTACCGCTCCA<br>GGTAGCCCGGCTGGCTCTCCTACCTCTACTGAGGAA<br>GGTACTTCTGAAAGCGCTACTCCTGAGTCTGGTCCA<br>GGTACCTCTACTGAACCGTCCGAAGGTAGCGCTCCA | 682 | GTSTEPSEGSAPGTSTEPSE<br>GSAPGTSTEPSEGSAPGTSE<br>SATPESGPGTSTEPSEGSAP<br>GTSTEPSEGSAPGSTSESPS<br>GTAPGTSPSGESSTAPGTSP<br>SGESSTAPGSPAGSPTSTEE<br>GTSESATPESGPGTSTEPSE<br>GSAP | 683 |
| LCW4 62_r57 | GGTACTTCTACTGAACCTTCCGAAGGTAGCGCTCCA<br>GGTAGCGAACCTGCTACTTCTGGTTCTGAAACCCCA<br>GGTAGCCCGGCTGGCTCTCCGACCTCCACCGAGGAA<br>GGTAGCCCGGCAGGCTCTCCGACCTCTACTGAGGAA<br>GGTACTTCTGAAAGCGCAACCCCGGAGTCCGGCCCA<br>GGTACCTCTACCGAACCGTCTGAGGGCAGCGCACCA<br>GGTACCTCTACTGAACCTTCCGAAGGCAGCGCTCCA<br>GGTACCTCTACCGAACCGTCCGAGGGCAGCGCACCA<br>GGTACTTCTGAAAGCGCAACCCCTGAATCCGGTCCA<br>GGTAGCTCTACTCCGTCTGGTGCAACCGGCTCCCCA<br>GGTTCTAGCCCGTCTGCTTCCACTGGTACTGGCCCA<br>GGTGCTTCCCCGGGCACCAGCTCTACTGGTTCTCCA | 684 | GTSTEPSEGSAPGSEPATSG<br>SETPGSPAGSPTSTEEGSPA<br>GSPTSTEEGTSESATPESGP<br>GTSTEPSEGSAPGTSTEPSE<br>GSAPGTSTEPSEGSAPGTSE<br>SATPESGPGSSTPSGATGSP<br>GSSPSASTGTGPGASPGTSS<br>TGSP | 685 |

TABLE 14-continued

DNA and amino acid sequences for AM144 segments

| Clone | Sequence Trimmed | SEQ ID NO: | Protein Sequence | SEQ ID NO: |
|---|---|---|---|---|
| LCW4 62_r61 | GGTAGCGAACCGGCTACTTCCGGCTCTGAGACTCCA GGTAGCCCTGCTGGCTCTCCGACCTCTACCGAAGAA GGTACCTCTGAAAGCGCTACCCCTGAGTCTGGCCCA GGTACCTCTACTGAACCTTCCGAAGGCAGCGCTCCA GGTACCTCTACCGAACCGTCCGAGGGCAGCGCACCA GGTACTTCTGAAAGCGCAACCCCTGAATCCGGTCCA GGTACCTCTACTCCGGAAAGCGGTTCCGCATCTCCA GGTTCTACCAGCGAATCCCCGTCTGGCACCGCACCA GGTTCTACTAGCTCTACTGCTGAATCTCCGGGCCCA GGTACTTCTGAAAGCGCTACTCCGGAGTCCGGTCCA GGTACCTCTACCGAACCGTCCGAAGGCAGCGCTCCA GGTACTTCTACTGAACCTTCTGAGGGTAGCGCTCCA | 686 | GSEPATSGSETPGSPAGSPT STEEGTSESATPESGPGTST EPSEGSAPGTSTEPSEGSAP GTSESATPESGPGTSTPESG SASPGSTSESPSGTAPGSTS STAESPGPGTSESATPESGP GTSTEPSEGSAPGTSTEPSE GSAP | 687 |
| LCW4 62_r64 | GGTACTTCTACCGAACCGTCCGAGGGCAGCGCTCCA GGTACTTCTACTGAACCTTCTGAAGGCAGCGCTCCA GGTACTTCTACTGAACCTTCCGAAGGTAGCGCACCA GGTACCTCTACCGAACCGTCTGAAGGTAGCGCACCA GGTACCTCTGAAAGCGCAACTCCTGAGTCCGGTCCA GGTACTTCTGAAAGCGCAACCCCGGAGTCTGGCCCA GGTACTCCTGGCAGCGGTACCGCATCTTCCTCTCCA GGTAGCTCTACTCCGTCTGGTGCAACTGGTTCCCCA GGTGCTTCTCCGGGTACCAGCTCTACCGGTTCTCCA GGTTCCACCAGCTCTACTGCTGAATCTCCTGGTCCA GGTACTCTCCTAGCGGTGAATCTTCTACTGCTCCA GGTACTTCTACTCCTGAAAGCGGCTCTGCTTCTCCA | 688 | GTSTEPSEGSAPGTSTEPSE GSAPGTSTEPSEGSAPGTST EPSEGSAPGTSESATPESGP GTSESATPESGPGTPGSGTA SSSPGSSTPSGATGSPGASP GTSSTGSPGSTSSTAESPGP GTSPSGESSTAPGTSTPESG SASP | 689 |
| LCW4 62_r67 | GGTAGCCCGGCAGGCTCTCCGACCTCTACTGAGGAA GGTACTTCTGAAAGCGCAACCCCGGAGTCCGGCCCA GGTACCTCTACCGAACCGTCTGAGGGCAGCGCACCA GGTACTTCTGAAAGCGCAACCCCTGAATCCGGTCCA GGTAGCGAACCGGCTACTTCTGGCTCTGAGACTCCA GGTACTTCTACCGAACCGTCCGAAGGTAGCGCACCA GGTAGCCCGGCTGGTTCTCCGACTTCCACCGAGGAA GGTACCTCTACTGAACCTTCTGAGGGTAGCGCTCCA GGTACCTCTACTGAACCTTCCGAAGGCAGCGCTCCA GGTACTTCTACCGAACCGTCCGAGGGCAGCGCACCA GGTACTTCTACTGAACCTTCTGAAGGCAGCGCTCCA GGTACTTCTACTGAACCTTCCGAAGGTAGCGCACCA | 690 | GSPAGSPTSTEEGTSESATP ESGPGTSTEPSEGSAPGTSE SATPESGPGSEPATSGSETP GTSTEPSEGSAPGSPAGSPT STEEGTSTEPSEGSAPGTST EPSEGSAPGTSTEPSEGSAP GTSTEPSEGSAPGTSTEPSE GSAP | 691 |
| LCW4 62_r69 | GGTACTTCTCCGAGCGGTGAATCTTCTACCGCACCA GGTTCTACTAGCTCTACCGCTGAATCTCCGGGCCCA GGTACTTCTCCGAGCGGTGAATCTTCTACTGCTCCA GGTACCTCTGAAAGCGCTACTCCGGAGTCTGGCCCA GGTACCTCTACTGAACGTCCGAGGGTAGCGCTCCA GGTACTTCTACTGAACCGTCCGAAGGTAGCGCACCA GGTTCTAGCCCTTCTGCATCTACTGGTACTGGCCCA GGTAGCTCTACTCCTTCTGGTGCTACCGGCTCTCCA GGTGCTTCTCCGGGTACTAGCTCTACCGGTTCTCCA GGTACTTCTACTCCGGAAAGCGGTTCCGCATCTCCA GGTACTTCTCCTAGCGGTGAATCTTCTACTGCTCCA GGTACCTCTCCTAGCGGCGAATCTTCTACTGCTCCA | 692 | GTSPSGESSTAPGSTSSTAE SPGPGTSPSGESSTAPGTSE SATPESGPGTSTEPSEGSAP GTSTEPSEGSAPGSSPSAST GTGPGSSTPSGATGSPGASP GTSSTGSPGTSTPESGSASP GTSPSGESSTAPGTSPSGES STAP | 693 |
| LCW4 62_r70 | GGTACCTCTGAAAGCGCTACTCCGGAGTCTGGCCCA GGTACCTCTACTGAACCTCTGAGGGTAGCGCTCCA GGTACTTCTACTGAACCGTCCGAAGGTAGCGCACCA GGTAGCCCTGCTGGCTCTCCGACTTCTACTGAGGAA GGTAGCCCGGCTGGTTCTCCGACTTCTACTGAGGAA GGTACTTCTACCGAACCTTCCGAAGGTAGCGCTCCA GGTTCTAGCCCTTCTGCTTCCACCGGTACTGGCCCA GGTAGCTCTACCCCTTCTGGTGCTACCGGCTCCCCA GGTAGCTCTACTCCTTCTGGTGCAACTGGTCTCCA GGTAGCGAACCGGCAACTTCCGGCTCTGAAACCCCA GGTACTTCTGAAAGCGCTACTCCGAGTCTGGCCCA GGTAGCGAACCTGCTACCTCTGGCTCTGAAACCCCA | 694 | GTSESATPESGPGTSTEPSE GSAPGTSTEPSEGSAPGSPA GSPTSTEEGSPAGSPTSTEE GTSTEPSEGSAPGSSPSAST GTGPGSSTPSGATGSPGSST PSGATGSPGSEPATSGSETP GTSESATPESGPGSEPATSG SETP | 695 |

TABLE 14-continued

DNA and amino acid sequences for AM144 segments

| Clone | Sequence Trimmed | SEQ ID NO: | Protein Sequence | SEQ ID NO: |
|---|---|---|---|---|
| LCW4 62_r72 | GGTACTTCTACCGAACCGTCCGAAGGCAGCGCTCCA GGTACCTCTACTGAACCTTCCGAGGGCAGCGCTCCA GGTTCCTCTACCGAACCTTCTGAAGGTAGCGCACCA GGTAGCTCTACCCCGTCTGGTGCTACCGGTTCCCCA GGTGCTTCTCCTGGTACTAGCTCTACCGGTTCTCCA GGTAGCTCTACCCCGTCTGGTGCTACTGGCTCTCCA GGTACTTCTGAAAGCGCAACCCCTGAATCCGGTCCA GGTAGCGAACCGGCTACTTCTGGCTCTGAGACTCCA GGTACTTCTACCGAACCGTCCGAAGGTAGCGCACCA GGTTCTACTAGCGAATCTCCTTCTGGCACTGCACCA GGTTCTACCAGCGAATCTCCGTCTGGCACTGCACCA GGTACCTCTACCCCTGAAAGCGGTTCCGCTTCTCCA | 696 | GTSTEPSEGSAPGTSTEPSE GSAPGTSTEPSEGSAPGSST PSGATGSPGASPGTSSTGSP GSSTPSGATGSPGTSESATP ESGPGSEPATSGSETPGTST EPSEGSAPGSTSESPSGTAP GSTSESPSGTAPGTSTPESG SASP | 697 |
| LCW4 62_r73 | GGTACCTCTACTCCTGAAAGCGGTTCTGCATCTCCA GGTTCCACTAGCTCTACCGCAGAATCTCCGGGCCCA GGTTCTACTAGCTCTACTGCTGAATCTCCTGGCCCA GGTTCTAGCCCTTCTGCATCTACTGGTACTGGCCCA GGTAGCTCTACTCCTTCTGGTGCTACCGGCTCTCCA GGTGCTTCTCCGGGTACTAGCTCTACCGGTTCTCCA GGTAGCGAACCGGCAACCTCCGGCTCTGAAACCCCA GGTACCTCTGAAAGCGCTACTCCTGAATCCGGCCCA GGTAGCCCGGCAGGTTCTCCGACTTCCACTGAGGAA GGTTCTACTAGCGAATCTCCTTCTGGCACTGCACCA GGTTCTACCAGCGAATCTCCGTCTGGCACTGCACCA GGTACCTCTACCCCTGAAAGCGGTTCCGCTTCTCCC | 698 | GTSTPESGSASPGSTSSTAE SPGPGSTSSTAESPGPGSSP SASTGTGPGSSTPSGATGSP GASPGTSSTGSPGSEPATSG SETPGTSESATPESGPGSPA GSPTSTEEGSTSESPSGTAP GSTSESPSGTAPGTSTPESG SASP | 699 |
| LCW4 62_r78 | GGTAGCCCGGCTGGCTCTCCTACCTCTACTGAGGAA GGTACTTCTGAAAGCGCTACTCCTGAGTCTGGTCCA GGTACCTCTACTGAACCGTCCGAAGGTAGCGCTCCA GGTTCTACCAGCGAATCTCCTTCTGGCACCGCACCA GGTTCTACTAGCGAATCCCGTCTGGTACCGCACCA GGTACTTCTCCTAGCGGCGAATCTTCTACCGCACCA GGTACCTCTACCGAACCTTCCGAAGGTAGCGCTCCA GGTAGCCCGGCAGGTTCTCCTACTTCCACTGAGGAA GGTACTTCTACCGAACCTTCTGAGGGTAGCGCACCA GGTAGCGAACCTGCAACCTCTGGCTCTGAAACCCCA GGTACCTCTGAAAGCGCTACTCCTGAATCTGGCCCA GGTACTTCTACTGAACCGTCCGAGGGCAGCGCACCA | 700 | GSPAGSPTSTEEGTSESATP ESGPGTSTEPSEGSAPGSTS ESPSGTAPGSTSESPSGTAP GTSPSGESSTAPGTSTEPSE GSAPGSPAGSPTSTEEGTST EPSEGSAPGSEPATSGSETP GTSESATPESGPGTSTEPSE GSAP | 701 |
| LCW4 62_r79 | GGTACCTCTACCGAACCTTCCGAAGGTAGCGCTCCA GGTAGCCCGGCAGGTTCTCCTACTTCCACTGAGGAA GGTACTTCTACCGAACCTTCTGAGGGTAGCGCACCA GGTACCTCCCCTAGCGGCGAATCTTCTACTGCTCCA GGTACCTCTCCTAGCGGCGAATCTTCTACCGCTCCA GGTACCTCCCCTAGCGGTGAATCTTCTACCGCACCA GGTTCTACCAGCGAATCCCCTTCTGGTACTGCTCCA GGTTCTACCAGCGAATCCCCTTCTGGCACCGCACCA GGTAC'TTCTACCCCTGAAAGCGGCTCCGCTTCTCCA GGTAGCGAACCTGCAACCTCTGGCTCTGAAACCCCA GGTACCTCTGAAAGCGCTACTCCTGAATCTGGCCCA GGTACTFCTACTGAACCGTCCGAGGGCAGCGCACCA | 702 | GTSTEPSEGSAPGSPAGSPT STEEGTSTEPSEGSAPGTSP SGESSTAPGTSPSGESSTAP GTSPSGESSTAPGSTSESPS GTAPGSTSESPSGTAPGTST PESGSASPGSEPATSGSETP GTSESATPESGPGTSTEPSE GSAP | 703 |
| LCW4 62_r87 | GGTAGCGAACCGGCAACCTCTGGCTCTGAAACCCCA GGTACCTCTGAAAGCGCTACTCCGGAATCTGGTCCA GGTACTTCTGAAAGCGCTACTCCGGAATCCGGTCCA GGTACTTCTCCGAGCGGTGAATCTTCTACCGCACCA GGTTCTACTAGCTCTACCGCTGAATCTCCGGGCCCA GGTACTTCTCCGAGCGGTGAATCTTCTACTGCTCCA GGTTCTACTAGCGAATCCCCGTCTGGTACTGCTCCA GGTACTTCCCCTAGCGGTGAATCTTCTACTGCTCCA GGTTCTACCAGCTCTACCGCAGAATCTCCGGGTCCA GGTAGCTCTACTCCGTCTGGTGCAACCGGTTCCCCA GGTAGCTCTACCCCTTCTGGTGCAACCGGCTCCCCA GGTAGCTCTACCCCTTCTGGTGCAAACTGGCTCTCC | 704 | GSEPATSGSETPGTSESATP ESGPGTSESATPESGPGTSP SGESSTAPGSTSSTAESPGP GTSPSGESSTAPGSTSESPS GTAPGTSPSGESSTAPGSTS STAESPGPGSSTPSGATGSP GSSTPSGATGSPGSSTPSGA NWLS | 705 |

TABLE 14-continued

DNA and amino acid sequences for AM144 segments

| Clone | Sequence Trimmed | SEQ ID NO: | Protein Sequence | SEQ ID NO: |
|---|---|---|---|---|
| LCW4 62_r88 | GGTAGCCCTGCTGGCTCTCCGACTTCTACTGAGGAA GGTAGCCCGGCTGGTTCTCCGACTTCTACTGAGGAA GGTACTTCTACCGAACCTTCCGAAGGTAGCGCTCCA GGTACCTCTACTGAACCTTCCGAAGGCAGCGCTCCA GGTACCTCTACCGAACCGTCCGAGGGCAGCGCACCA GGTACTTCTGAAAGCGCAACCCCTGAATCCGGTCCA GGTGCATCTCCTGGTACCAGCTCTACCGGTTCTCCA GGTAGCTCTACTCCTTCTGGTGCTACTGGCTCTCCA GGTGCTTCCCCGGGTACCAGCTCTACCGGTTCTCCA GGTAGCTCTACCCCGTCTGGTGCTACTGG1TCTCCA GGTACTCCGGGCAGCGGTACTGCTTCTTCCTCTCCA GGTAGCTCTACCCCTTCTGGTGCTACTGGCTCTCCA | 706 | GSPAGSPTSTEEGSPAGSPT STEEGTSTEPSEGSAPGTST EPSEGSAPGTSTEPSEGSAP GTSESATPESGPGASPGTSS TGSPGSSTPSGATGSPGASP GTSSTGSPGSSTPSGATGSP GTPGSGTASSSPGSSTPSGA TGSP | 707 |
| LCW4 62_r89 | GGTAGCTCTACCCCGTCTGGTGCTACTGGTTCTCCA GGTACTCCGGGCAGCGGTACTGCTTCTTCCTCTCCA GGTAGCTCTACCCCTTCTGGTGCTACTGGCTCTCCA GGTAGCCCGGCTGGCTCTCCTACCTCTACTGAGGAA GGTACTTCTGAAAGCGCTACTCCTGAGTCTGGTCCA GGTACCTCTACTGAACCGTCCGAAGGTAGCGCTCCA GGTACCTCTGAAAGCGCAACTCCTGAGTCTGGCCCA GGTAGCGAACCTGCTACCTCCGGCTCTGAGACTCCA GGTACCTCTGAAAGCGCAACCCCGGAATCTGGTCCA GGTACTTCTACTGAACCGTCTGAAGGTAGCGCACCA GGTACTTCTGAAAGCGCAACCCCGGAATCCGGCCCA GGTACCTCTGAAAGCGCAACCCCGGAGTCCGGCCCA | 708 | GSSTPSGATGSPGTPGSGTA SSSPGSSTPSGATGSPGSPA GSPTSTEEGTSESATPESGP GTSTEPSEGSAPGTSESATP ESGPGSEPATSGSETPGTSE SATPESGPGTSTEPSEGSAP GTSESATPESGPGTSESATP ESGP | 709 |

Example 7

Construction of XTEN_AM288

The entire library LCW0462 was dimerized as described in Example 6 resulting in a library of XTEN_AM288 clones designated LCW0463. 1512 isolates from library LCW0463 were screened using the protocol described in Example 6. 176 highly expressing clones were sequenced and 40 preferred XTEN_AM288 segments were chosen for the construction of multifunctional proteins that contain multiple XTEN segments with 288 amino acid residues.

Example 8

Construction of XTEN_AM432

We generated a library of XTEN_AM432 segments by recombining segments from library LCW0462 of XTEN_AM144 segments and segments from library LCW0463 of XTEN_AM288 segments. This new library of XTEN_AM432 segment was designated LCW0464. Plasmid was isolated from cultures of E. coli harboring LCW0462 and LCW0463, respectively. 1512 isolates from library LCW0464 were screened using the protocol described in Example 6. 176 highly expressing clones were sequenced and 39 preferred XTEN_AM432 segment were chosen for the construction of longer XTENs and for the construction of multifunctional proteins that contain multiple XTEN segments with 432 amino acid residues.

In parallel we constructed library LMS0100 of XTEN_AM432 segments using preferred segments of XTEN_AM 144 and XTEN_AM288. Screening this library yielded 4 isolates that were selected for further construction

Example 9

Construction of XTEN_AM875

The stuffer vector pCW0359 was digested with BsaI and KpnI to remove the stuffer segment and the resulting vector fragment was isolated by agarose gel purification.

We annealed the phosphorylated oligonucleotide BsaI-AscI-KpnIforP: AGGTGCAAGCGCAAGCGGCGCGC-CAAGCACGGGAGGTTCGTCTTCACTCGAGGGTAC (SEQ ID NO: 710) and the non-phosphorylated oligonucleotide BsaI-AscI-KpnIrev: CCTCGAGTGAAGACGAAC-CTCCCGTGCTTGGCGCGCCGCTTGCGCTTGC (SEQ ID NO: 711) for introducing the sequencing island A (SI-A) which encodes amino acids GASASGAPSTG (SEQ ID NO: 712) and has the restriction enzyme AscI recognition nucleotide sequence GGCGCGCC inside. The annealed oligonucleotide pairs were ligated with BsaI and KpnI digested stuffer vector pCW0359 prepared above to yield pCW0466 containing SI-A. We then generated a library of XTEN_AM443 segments by recombining 43 preferred XTEN_AM432 segments from Example 8 and SI-A segments from pCW0466 at C-terminus using the same dimerization process described in Example 5. This new library of XTEN_AM443 segments was designated LCW0479.

We generated a library of XTEN_AM875 segments by recombining segments from library LCW0479 of XTEN_AM443 segments and 43 preferred XTEN_AM432 segments from Example 8 using the same dimerization process described in Example 5. This new library of XTEN_AM875 segment was designated LCW0481.

Example 10

Construction of XTEN_AM1318

We annealed the phosphorylated oligonucleotide BsaI-FseI-KpnIforP: AGGTCCAGAACCAACGGGGCCGGC- CCCAAGCGGAGGTTCGTCTTCACTCGAGGGTAC (SEQ ID NO: 713) and the non-phosphorylated oligonucleotide BsaI-FseI-KpnIrev: CCTCGAGTGAAGACGAACCTCCGCTGGGGCCGGCCCCGTTGGTTCTGG (SEQ ID NO: 714) for introducing the sequencing island B (SI-B) which encodes amino acids GPEPTGPAPSG (SEQ ID NO: 715) and has the restriction enzyme FseI recognition nucleotide sequence GGCCGGCC inside. The annealed oligonucleotide pairs were ligated with BsaI and KpnI digested stuffer vector pCW0359 as used in Example 9 to yield pCW0467 containing SI-B. We then generated a library of XTEN_AM443 segments by recombining 43 preferred XTEN_AM432 segments from Example 8 and SI-B segments from pCW0467 at C-terminus using the same dimerization process described in Example 5. This new library of XTEN_AM443 segments was designated LCW0480.

We generated a library of XTEN_AM 1318 segments by recombining segments from library LCW0480 of XTEN_AM443 segments and segments from library LCW0481 of XTEN_AM875 segments using the same dimerization process as in Example 5. This new library of XTEN_AM1318 segment was designated LCW0487.

Example 11

Construction of XTEN_AD864

Using the several consecutive rounds of dimerization, we assembled a collection of XTEN_AD864 sequences starting from segments of XTEN_AD36 listed in Example 1. These sequences were assembled as described in Example 5. Several isolates from XTEN_AD864 were evaluated and found to show good expression and excellent solubility under physiological conditions. One intermediate construct of XTEN_AD576 was sequenced. This clone was evaluated in a PK experiment in cynomolgus monkeys and a half-life of about 20 h was measured.

Example 12

Construction of XTEN_AF864

Using the several consecutive rounds of dimerization, we assembled a collection of XTEN_AF864 sequences starting from segments of XTEN_AF36 listed in Example 3. These sequences were assembled as described in Example 5. Several isolates from XTEN_AF864 were evaluated and found to show good expression and excellent solubility under physiological conditions. One intermediate construct of XTEN_AF540 was sequenced. This clone was evaluated in a PK experiment in cynomolgus monkeys and a half-life of about 20 h was measured. A full length clone of XTEN_AF864 had excellent solubility and showed half-life exceeding 60 h in cynomolgus monkeys. A second set of XTEN_AF sequences was assembled including a sequencing island as described in Example 9.

Example 13

Construction of XTEN_AG864

Using the several consecutive rounds of dimerization, we assembled a collection of XTEN_AG864 sequences starting from segments of XTEN_AD36 listed in Example 1. These sequences were assembled as described in Example 5. Several isolates from XTEN_AG864 were evaluated and found to show good expression and excellent solubility under physiological conditions. A full-length clone of XTEN_AG864 had excellent solubility and showed half-life exceeding 60 h in cynomolgus monkeys.

Example 14

Construction of N-Terminal Extensions of XTEN-Construction and Screening of 12 mer Addition Libraries This example details a step in the optimization of the N-terminus of the XTEN protein to promote the initiation of translation to allow for expression of XTEN fusions at the N-terminus of fusion proteins without the presence of a helper domain. Historically expression of proteins with XTEN at the N-terminus was poor, yielding values that would essentially undetectable in the GFP fluorescence assay (<25% of the expression with the N-terminal CBD helper domain). To create diversity at the codon level, seven amino acid sequences were selected and prepared with a diversity of codons. Seven pairs of oligonucleotides encoding 12 amino acids with codon diversities were designed, annealed and ligated into the NdeI/BsaI restriction enzyme digested stuffer vector pCW0551 (Stuffer-XTEN_AM875-GFP), and transformed into E. coli BL21Gold(DE3) competent cells to obtain colonies of seven libraries. The resulting clones have N-terminal XTEN 12mers fused in-frame to XTEN_AM875-GFP to allow use of GFP fluorescence for screening the expression. Individual colonies from the seven created libraries were picked and grown overnight to saturation in 500 μl of super broth media in a 96 deep well plate. The number of colonies picked ranged from approximately half to a third of the theoretical diversity of the library (see Table 15).

TABLE 15

Theoretical Diversity and Sampling Numbers for 12 mer Addition Librabries. The amino acid residues with randomized codons are underlined.

| Library | Motif Family | Amino Acid Sequence | SEQ ID NO: | Theoretical Diversity | Number screened |
|---|---|---|---|---|---|
| LCW546 | AE12 | MA<u>SPAGS</u>P<u>TSTEE</u> | 716 | 572 | 2 plates (168) |
| LCW547 | AE12 | MA<u>TSES</u>A<u>TPES</u>GP | 717 | 1536 | 5 plates (420) |
| LCW548 | AF12 | MA<u>TSPSGESSTAP</u> | 718 | 192 | 2 plates (168) |
| LCW549 | AF12 | ME<u>STSS</u>T<u>AES</u>PGP | 719 | 384 | 2 plates (168) |

TABLE 15-continued

Theoretical Diversity and Sampling Numbers for 12 mer Addition Librabries. The amino acid residues with randomized codons are underlined.

| Library | Motif Family | Amino Acid Sequence | SEQ ID NO: | Theoretical Diversity | Number screened |
|---------|--------------|---------------------|------------|----------------------|-----------------|
| LCW552 | AG12 | MASSTPSGATGSP | 720 | 384 | 2 plates (168) |
| LCW553 | AG12 | MEASPGTSSTGSP | 721 | 384 | 2 plates (168) |
| LCW554 | (CBD-like) | MASTPESGSSG | 722 | 32 | 1 plate (84) |

Figure 9:
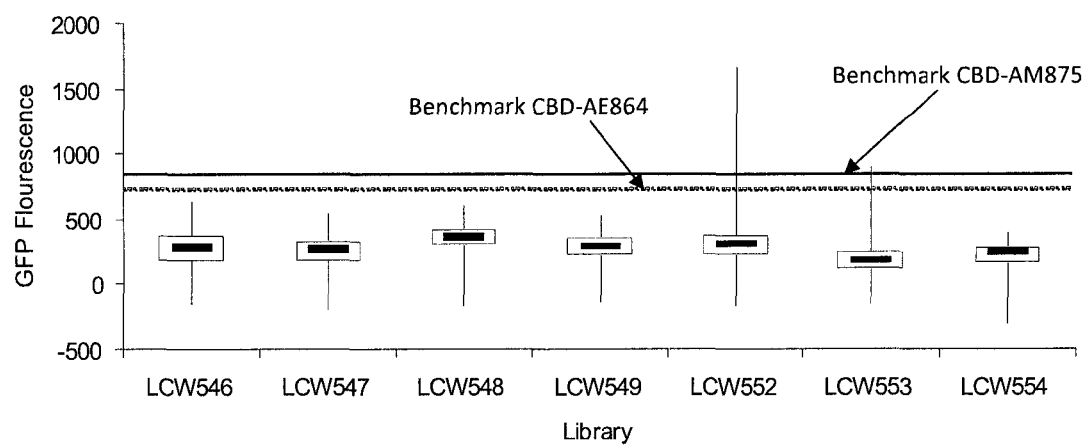
FIG. 9 shows results of expression assays for the indicated constructs comprising GFP and XTEN sequences. The expression cultures were assayed using a fluorescence plate reader (excitation 395 nm, emission 510 nm) to determine the amount of GFP reporter present. The results, graphed as box and whisker plots, indicate that while median expression levels were approximately half of the expression levels compared to the "benchmark" CBD N-terminal helper domain, the best clones from the libraries were much closer to the benchmarks, indicating that further optimization around those sequences was warranted. The results also show that the libraries starting with amino acids MA had better expression levels than those beginning with ME (see. Example 14).

The saturated overnight cultures were used to inoculate fresh 500 µl cultures in auto-induction media in which they were grown overnight at 26° C. These expression cultures were then assayed using a fluorescence plate reader (excitation 395 nm, emission 510 nm) to determine the amount of GFP reporter present (see FIG. 9 for results of expression assays). The results, graphed as box and whisker plots, indicate that while median expression levels were approximately half of the expression levels compared to the "benchmark" CBD N-terminal helper domain, the best clones from the libraries were much closer to the benchmarks, indicating that further optimization around those sequences was warranted. This is in contrast to previous XTEN versions that were <25% of the expression levels of the CBD N-terminal benchmark. The results also show that the libraries starting with amino acids MA had better expression levels than those beginning with ME. This was most apparent when looking at the best clones, which were closer to the benchmarks as they mostly start with MA. Of the 176 clones within 33% of the CBD-AM875 benchmark, 87% begin with MA, where as only 75% of the sequences in the libraries beginning with MA, a clear over representation of the clones beginning with MA at the highest level of expression. 96 of the best clones were sequenced to confirm identity and twelve sequences (see Table 16), 4 from LCW546, 4 from LCW547 and 4 from LCW552 were selected for further optimization.

TABLE 16

Advanced 12 mer DNA Nucleotide Sequences

| Clone | DNA Nucleotide Sequence | SEQ ID NO: |
|-------|-------------------------|------------|
| LCW5 46_02 | ATGGCTAGTCCGGCTGGCTCTCCGACCT CCACTGAGGAAGGTACTTCTACT | 723 |
| LCW5 46_06 | ATGGCTAGTCCTGCTGGCTCTCCAACCT CCACTGAGGAAGGTACTTCTACT | 724 |
| LCW5 46_07 | ATGGCTAGTCCAGCAGGCTCTCCTACCT CCACCGAGGAAGGTACTTCTACT | 725 |
| LCW5 46_09 | ATGGCTAGTCCTGCTGGCTCTCCGACCT CTACTGAGGAAGGTACTTCTACT | 726 |
| LCW5 47_03 | ATGGCTACATCCGAAAGCGCAACCCCTG AGTCCGGTCCAGGTACTTCTACT | 727 |
| LCW5 47_06 | ATGGCTACATCCGAAAGCGCAACCCCTG AATCTGGTCCAGGTACTTCTACT | 728 |
| LCW5 47_10 | ATGGCTACGTCTGAAAGCGCTACTCCGG AATCTGGTCCAGGTACTTCTACT | 729 |

TABLE 16-continued

Advanced 12 mer DNA Nucleotide Sequences

| Clone | DNA Nucleotide Sequence | SEQ ID NO: |
|-------|-------------------------|------------|
| LCW5 47_17 | ATGGCTACGTCCGAAAGCGCTACCCCTG AATCCGGTCCAGGTACTTCTACT | 730 |
| LCW5 52_03 | ATGGCTAGTTCTACCCCGTCTGGTGCAA CCGGTTCCCCAGGTACTTCTACT | 731 |
| LCW5 52_05 | ATGGCTAGCTCCACTCCGTCTGGTGCTA CCGGTTCCCCAGGTACTTCTACT | 732 |
| LCW5 52_10 | ATGGCTAGCTCTACTCCGTCTGGTGCTA CTGGTTCCCCAGGTACTTCTACT | 733 |
| LCW5 52_11 | ATGGCTAGTTCTACCCCTTCTGGTGCTA CTGGTTCTCCAGGTACTTCTACT | 734 |

Example 15

Construction of N-Terminal Extensions of XTEN-Construction and Screening of Libraries Optimizing Codons 3 and 4

Figure 11:
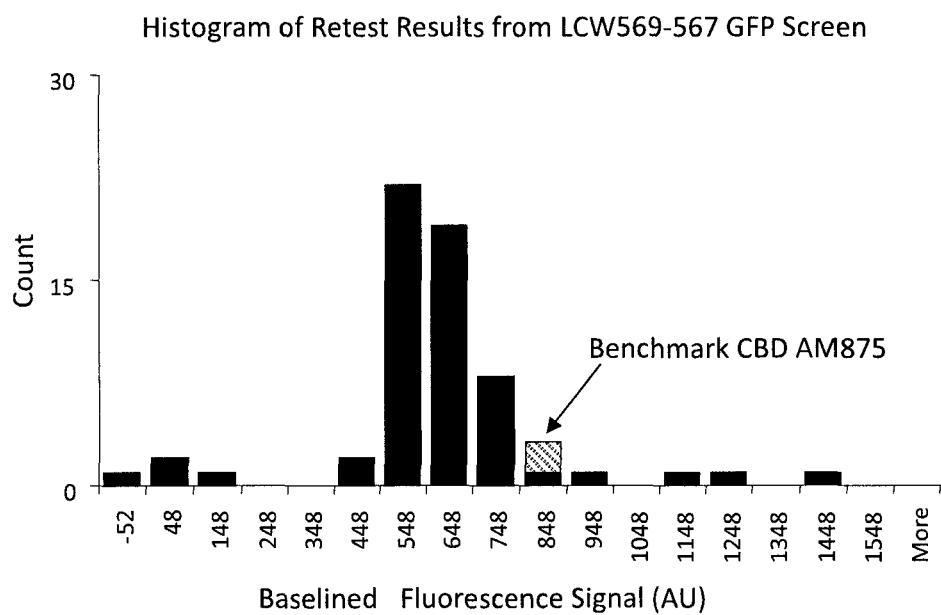
FIG. 11 shows a histogram of a retest of the top 75 clones after the optimization step, as described in Example 15, for GFP fluorescence signal, relative to the benchmark CBD_AM875 construct. The results indicated that several clones were now superior to the benchmark clones.

This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the third and fourth codons were randomized to determine preferences. Three libraries, based upon best clones from LCW546, LCW547 and LCW552, were designed with the third and fourth residues modified such that all combinations of allowable XTEN codons were present at these positions (see FIG. 10). In order to include all the allowable XTEN codons for each library, nine pairs of oligonucleotides encoding 12 amino acids with codon diversities of third and fourth residues were designed, annealed and ligated into the NdeI/BsaI restriction enzyme digested stuffer vector pCW0551 (Stuffer-XTEN_AM875-GFP), and transformed into *E. coli* BL21Gold(DE3) competent cells to obtain colonies of three libraries LCW0569-571. With 24 XTEN codons the theoretical diversity of each library is 576 unique clones. A total of 504 individual colonies from the three created libraries were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media in which were grown overnight at 26° C. These expression cultures were then assayed using a fluorescence plate reader (excitation 395 nm, emission 510 nm) to determine the amount of GFP reporter present. The top 75 clones from the screen were sequenced and retested for GFP reporter expression versus the benchmark samples (see FIG. 11). 52 clones yielded usable sequencing data and were used for subsequent analysis. The results were broken down by library and indicate that LCW546 was the superior library. The results are presented in Table 17. Surprisingly, it was discovered that base-lined fluorescence readings for the best clones were ~900 AU, whereas the CBD N-terminal benchmark was only ~600 AU. This indicates that this library had instituted an approximately 33% improvement over the best clones from the previous library which were approximately equal in expression to the CBD N-terminal benchmark (Example 14).

TABLE 17

Third and Fourth Codon Optimization Library Comparison

|  | LCW569 | LCW570 | LCW571 |
|---|---|---|---|
| N | 21 | 15 | 16 |
| Mean Fluorescence (AU) | 628 | 491 | 537 |
| SD | 173 | 71 | 232 |
| CV | 28% | 15% | 43% |

Further trends were seen in the data showing preferences for particular codons at the third and fourth position. Within the LCW569 library the glutamate codon GAA at the third position and the threonine codon ACT were associated with higher expression as seen in Table 18.

TABLE 18

Preferred Third and Fourth Codons in LCW569

|  | 3 = GAA | Rest | 4 = ACT | Rest |
|---|---|---|---|---|
| N | 8 | 13 | 4 | 17 |
| Mean Fluorescence (AU) | 749 | 554 | 744 | 601 |
| SD | 234 | 47 | 197 | 162 |
| CV | 31% | 9% | 26% | 27% |

Additionally, the retest of the top 75 clones indicated that several were now superior to the benchmark clones.

Example 16

Figure 12:
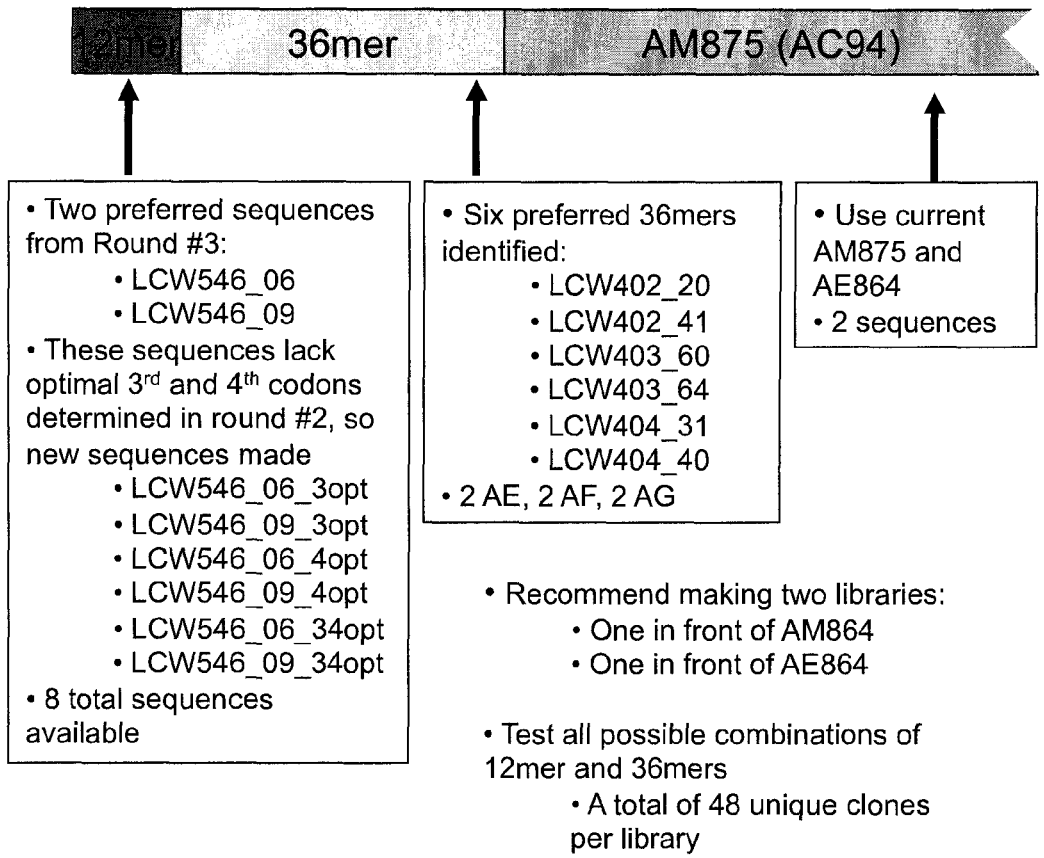
FIG. 12 is a schematic of a combinatorial approach undertaken for the union of codon optimization preferences for two regions of the N-terminus 48 amino acids, as described in Example 16. The approach created novel 48 mers at the N-terminus of the XTEN protein for evaluation of the optimization of expression that resulted in leader sequences that may be a solution for expression of XTEN proteins where the XTEN is N-terminal to the GP.

Construction of N-Terminal Extensions of XTEN-Construction and Screening of Combinatorial 12 mer and 36 mer Libraries This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the N-terminus was examined in a broader context by combining the 12 selected 12 mer sequences (see Example supra) at the very N-terminus followed by 125 previously constructed 36 mer segments (see example supra) in a combinatorial manner. This created novel 48 mers at the N-terminus of the XTEN protein and enabled the assessment of the impact of longer-range interactions at the N-terminus on expression of the longer sequences (FIG. 12). Similar to the dimerization procedures used to assemble 36 mers (see Example infra), the plasmids containing the 125 selected 36 mer segments were digested with restriction enzymes BbsI/NcoI and the appropriate fragment was gel-purified. The plasmid from clone AC94 (CBD-XTEN_AM875-GFP) was also digested with BsaI/NcoI and the appropriate fragments were gel-purified. These fragments were ligated together and transformed into E. coli BL21Gold(DE3) competent cells to obtain colonies of the library LCW0579, which also served as the vector for further cloning 12 selected 12 mers at the very N-terminus. The plasmids of LCW0579 were digested with NdeI/EcoRI/BsaI and the appropriate fragments were gel-purified. 12 pairs of oligonucleotides encoding 12 selected 12 mer sequences were designed, annealed and ligated with the NdeI/EcoRI/BsaI digested LCW0579 vector, and transformed into E. coli BL21Gold(DE3) competent cells to obtain colonies of the library LCW0580. With a theoretical diversity of 1500 unique clones, a total of 1512 individual colonies from the created library were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media that were grown overnight at 26° C. These expression cultures were then assayed using a fluorescence plate reader (excitation 395 nm, emission 510 nm) to determine the amount of GFP reporter present. The top 90 clones were sequenced and retested for GFP reporter expression. 83 clones yielded usable sequencing data and were used for subsequent analysis. The sequencing data was used to determine the lead 12 mer that was present in each clone and the impact of each 12 mer on expression was assessed. Clones LCW546_06 and LCW546_09 stood out as being the superior N-terminus (see Table 19).

TABLE 19

Relative Performance of Clones Starting with LCW546 06 and LCW459 09

|  | LCW546_06 | All Others | LCW546_09 | All Others |
|---|---|---|---|---|
| N | 11 | 72 | 9 | 74 |
| Mean Fluorescence (AU) | 1100 | 752 | 988 | 775 |
| SD | 275 | 154 | 179 | 202 |
| CV | 25% | 20% | 18% | 26% |

The sequencing and retest also revealed several instances of independent replicates of the same sequence in the data producing similar results, thus increasing confidence in the assay. Additionally, 10 clones with 6 unique sequences were superior to the benchmark clone. They are presented in Table 20. It was noted that these were the only occurrences of these sequences and in no case did one of these sequences occur and fail to beat the bench-mark clone. These six sequences were advanced for further optimization.

TABLE 20

Combinatorial 12 mer and 36 mer Clones Superior to Benchmark Clone

| Clone Name | First 60 codons | SEQ ID NO: | 12 mer Name | 36 mer Name |
|---|---|---|---|---|
| LCW580_51 | ATGGCTAGTCCTGCTGGCTCTCCAACCTCCACTGAGGAAGGTGCA TCCCCGGGCACCAGCTCTACCGGTTCTCCAGGTAGCTCTACCCCG TCTGGTGCTACCGGCTCTCCAGGTAGCTCTACCCCGTCTGGTGCT ACTGGCTCTCCAGGTACTTCTACTGAACCGTCTGAAGGCAGCGCA | 735 | LCW5 46_06 | LCW04 04_040 |
| LCW580_81 | ATGGCTAGTCCTGCTGGCTCTCCAACCTCCACTGAGGAAGGTGCA TCCCCGGGCACCAGCTCTACCGGTTCTCCAGGTAGCTCTACCCCG TCTGGTGCTACCGGCTCTCCAGGTAGCTCTACCCCGTCTGGTGCT ACTGGCTCTCCAGGTACTTCTACTGAACCGTCTGAAGGCAGCGCA | 736 | LCW5 46_06 | LCW04 04_040 |
| LCW580_38 | ATGGCTAGTCCTGCTGGCTCTCCAACCTCCACTGAGGAAGGTACT TCTACCGAACCGTCCGAGGGTAGCGCACCAGGTAGCCCAGCAGGT TCTCCTACCTCCACCGAGGAAGGTACTTCTACCGAACCGTCCGAG GGTAGCGCACCAGGTACTTCTACTGAACCGTCTGAAGGCAGCGCA | 737 | LCW5 46_06 | LCW04 02_041 |
| LCW580_63 | ATGGCTAGTCCTGCTGGCTCTCCGACCTCTACTGAGGAAGGTACT TCTACTGAACCGTCTGAAGGCAGCGCACCAGGTAGCGAACCGGCT ACTTCCGGTTCTGAAACCCAGGTAGCCCAGCAGGTTCTCCAACT TCTACTGAAGAAGGTACTTCTACTGAACCGTCTGAAGGCAGCGCA | 738 | LCW5 46_09 | LCW04 02_020 |
| LCW580_06 | ATGGCTAGTCCTGCTGGCTCTCCAACCTCCACTGAGGAAGGTACC CCGGGTAGCGGTACTGCTTCTTCCTCTCCAGGTAGCTCTACCCCT TCTGGTGCAACCGGCTCTCCAGGTGCTTCTCCGGGCACCAGCTCT ACCGGTTCTCCAGGTACTTCTACTGAACCGTCTGAAGGCAGCGCA | 739 | LCW5 46_06 | LCW04 04_031 |
| LCW580_35 | ATGGCTAGTCCTGCTGGCTCTCCGACCTCTACTGAGGAAGGTACT TCTACTGAACCGTCTGAAGGCAGCGCACCAGGTAGCGAACCGGCT ACTTCCGGTTCTGAAACCCAGGTAGCCCAGCAGGTTCTCCAACT TCTACTGAAGAAGGTACTTCTACTGAACCGTCTGAAGGCAGCGCA | 740 | LCW5 46_09 | LCW04 02_020 |
| LCW580_67 | ATGGCTAGTCCTGCTGGCTCTCCGACCTCTACTGAGGAAGGTACC TCCCCTAGCGGCGAATCTTCTACTGCTCCAGGTACCTCTCCTAGC GGCGAATCTTCTACCGCTCCAGGTACCTCCCCTAGCGGTGAATCT TCTACCGCACCAGGTACTTCTACTGAACCGTCTGAAGGCAGCGCA | 741 | LCW5 46_09 | LCW04 03_064 |
| LCW580_13 | ATGGCTAGTCCTGCTGGCTCTCCGACCTCTACTGAGGAAGGTACC TCTACTCCGGAAAGCGGTTCCGCATCTCCAGGTTCTACCAGCGAA TCCCCGTCTGGCACCGCACCAGGTTCTACTAGCTCTACTGCTGAA TCTCCGGGCCCAGGTACTTCTACTGAACCGTCTGAAGGCAGCGCA | 742 | LCW5 46_09 | LCW04 03_060 |
| LCW580_88 | ATGGCTAGTCCTGCTGGCTCTCCGACCTCTACTGAGGAAGGTACC TCCCCTAGCGGCGAATCTTCTACTGCTCCAGGTACCTCTCCTAGC GGCGAATCTTCTACCGCTCCAGGTACCTCCCCTAGCGGTGAATCT TCTACCGCACCAGGTACTTCTACTGAACCGTCTGAAGGCAGCGCA | 743 | LCW5 46_09 | LCW04 03_064 |
| LCW580_11 | ATGGCTAGTCCTGCTGGCTCTCCGACCTCTACTGAGGAAGGTACC TCTACTCCGGAAAGCGGTTCCGCATCTCCAGGTTCTACCAGCGAA TCCCCGTCTGGCACCGCACCAGGTTCTACTAGCTCTACTGCTGAA TCTCCGGGCCCAGGTACTTCTACTGAACCGTCTGAAGGCAGCGCA | 744 | LCW5 46_09 | LCW04 03_060 |

Example 17

Construction of N-Terminal Extensions of XTEN-Construction and Screening of Combinatorial 12 mer and 36 mer Libraries for XTEN-AM875 and XTEN-AE864

This example details a step in the optimization of the N-terminus of the XTEN protein to promote the initiation of translation to allow for expression of XTEN fusions at the N-terminus of proteins without the presence of a helper domain. With preferences for the first four codons (see Examples supra, and for the best pairing of N-terminal 12 mers and 36 mers (see Example supra) established, a combinatorial approach was undertaken to examine the union of these preferences. This created novel 48 mers at the N-terminus of the XTEN protein and enabled the testing of the confluence of previous conclusions. Additionally, the ability of these leader sequences to be a universal solution for all XTEN proteins was assessed by placing the new 48 mers in front of both XTEN-AE864 and XTEN-AM875. Instead of using all 125 clones of 36 mer segment, the plasmids from 6 selected clones of 36 mer segment with best GFP expression in the combinatorial library were digested with NdeI/EcoRI/BsaI and the appropriate fragments were gel-purified. The plasmids from clones AC94 (CBD-XTEN_AM875-GFP) and AC104 (CBD-XTEN_AE864-GFP) were digested with digested with NdeI/EcoRI/BsaI and the appropriate fragments were gel-purified. These fragments were ligated together and transformed into E. coli BL21Gold(DE3) competent cells to obtain colonies of the libraries LCW0585 (-XTEN_AM875-GFP) and LCW0586 (-XTEN_AE864-GFP), which could also serve as the vectors for further cloning 8 selected 12 mers at the very N-terminus. The plasmids of LCW0585 and LCW0586 were digested with NdeI/EcoRI/BsaI and the appropriate fragments were gel-purified. 8 pairs of oligonucleotides encoding 8 selected 12 mer sequences with best GFP expression in the previous (Generation 2) screening were designed, annealed and ligated with the NdeI/EcoRI/BsaI digested LCW0585 and LCW0586 vectors, and transformed into *E. coli* BL21Gold (DE3) competent cells to obtain colonies of the final libraries LCW0587 (XTEN_AM923-GFP) and LCW0588 (XTEN_AE912-GFP). With a theoretical diversity of 48 unique clones, a total of 252 individual colonies from the created libraries were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media in which were grown overnight at 26° C. These expression cultures were then assayed using a fluorescence plate reader (excitation 395 nm, emission 510 nm) to determine the amount of GFP reporter present. The top 36 clones were sequenced and retested for GFP reporter expression. 36 clones yielded usable sequencing data and these 36 were used for the subsequent analysis. The sequencing data determined the 12 mer, the third codon, the fourth codon and the 36 mer present in the clone and revealed that many of the clones were independent replicates of the same sequence. Additionally, the retest results for these clones are close in value, indicating the screening process was robust. Preferences for certain combinations at the N-terminus were seen and were consistently yielding higher fluorescence values approximately 50% greater than the benchmark controls (see Tables 21 and 22). These date support the conclusion that the inclusion of the sequences encoding the optimized N-terminal XTEN into the fusion protein genes conferred a marked enhancement on the expression of the fusion proteins.

TABLE 21

Preferred N-terminal Combinations for XTEN-AM875

| Clone Name | Number of Replicates | 12 mer | 36 mer | Mean | SD | CV |
|---|---|---|---|---|---|---|
| CBD-AM875 | NA | NA | NA | 1715 | 418 | 16% |
| LCW587_08 | 7 | LCW546_06_3 = GAA | LCW404_40 | 2333 | 572 | 18% |
| LCW587_17 | 5 | LCW546_09_3 = GAA | LCW403_64 | 2172 | 293 | 10% |

TABLE 22

Preferred N-terminal Combinations for XTEN-AE864

| Clone Name | Number of Replicates | 12 mer | 36 mer | Mean | SD | CV |
|---|---|---|---|---|---|---|
| AC82 | NA | NA | NA | 1979 | 679 | 24% |
| LCW588_14 | 8 | LCW546_06_opt3 | LCW404_31 | 2801 | 240 | 6% |
| LCW588_27 | 2 | LCW546_06_opt34 | LCW404_40 | 2839 | 556 | 15% |

Figure 13:
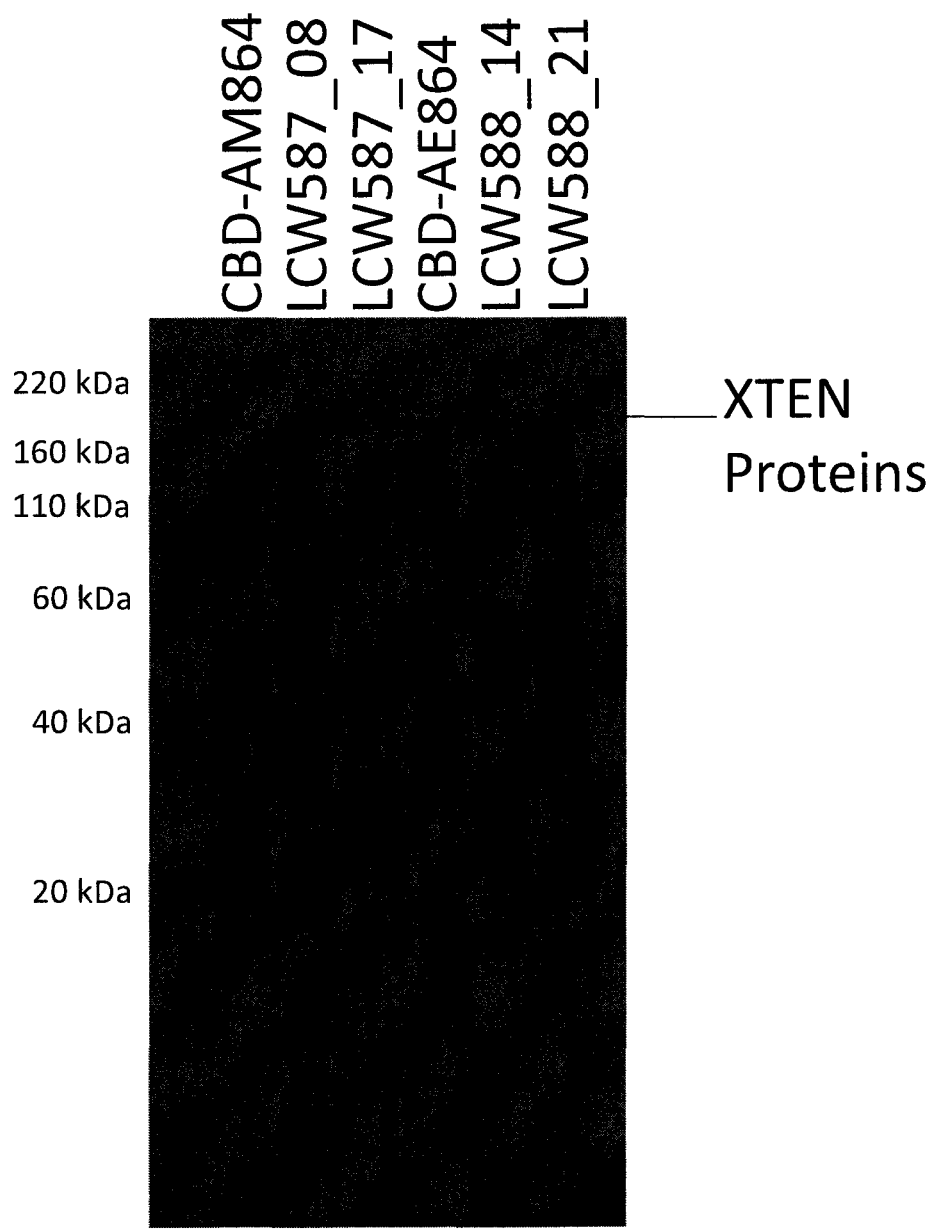
FIG. 13 shows an SDS-PAGE gel confirming expression of preferred clones obtained from the XTEN N-terminal codon optimization experiments, in comparison to benchmark XTEN clones comprising CBD leader sequences at the N-terminus of the construct sequences.

Notably, the preferred combination of the N-terminal for the XTEN-AM875 and the preferred combination for the XTEN-AE864 are not the same (Tables 21 and 22), indicating more complex interactions further than 150 bases from the initiation site influence expression levels. The sequences for the preferred nucleotide sequences are listed in Table 23 and the preferred clones were analyzed by SDS-PAGE to independently confirm expression (see FIG. 13). The complete sequences of XTEN_AM923 and XTEN_AE912 were selected for further analysis.

TABLE 23

Preferred DNA Nucleotide Sequences for first 48 Amino Acid Residues of N-terminal XTEN-AM875 and XTEN-AE864

| Clone Name | XTEN Modified | Nucleotide Sequence | SEQ ID NO |
|---|---|---|---|
| LCW587_08 | AM875 | ATGGCTGAACCTGCTGGCTCTCCAACCTCCACTGAGGAAGGTGCATCCCCGGGCACCAGCTCTACCGGTTCTCCAGGTAGCTCTACCCCGTCTGGTGCTACCGGCTCTCCAGGTAGCTCTACCCCGTCTGGTGCTACTGGCTCTCCAGGTACTTCTACTGAACCGTCTGAAGGCAGCGCA | 745 |
| LCW587_17 | AM875 | ATGGCTGAACCTGCTGGCTCTCCGACCTCTACTGAGGAAGGTACCTCCCCTAGCGGCGAATCTTCTACTGCTCCAGGTACCTCTCCTAGCGGCGAATCTTCTACCGCTCCAGGTACCTCCCCTAGCGGTGAATCTTCTACCGCACCAGGTACTTCTACTGAACCGTCTGAAGGCAGCGCA | 746 |

TABLE 23-continued

Preferred DNA Nucleotide Sequences for first 48 Amino
Acid Residues of N-terminal XTEN-AM875 and XTEN-AE864

| XTEN Clone Name | Modified | Nucleotide Sequence | SEQ ID NO |
|---|---|---|---|
| LCW5_88_14 | AE864 | ATGGCTGAACCTGCTGGCTCTCCAACCTCCACTGAGGAAGGTACCCCGGGTAGCGGTACTGCTTCTTCCTCTCCAGGTAGCTCTACCCCTTCTGGTGCAACCGGCTCTCCAGGTGCTTCTCCGGGCACCAGCTCTACCGGTTCTCCAGGTAGCCCGGCTGGCTCTCCTACCTCTACTGAG | 747 |
| LCW5_88_27 | AE864 | ATGGCTGAAACTGCTGGCTCTCCAACCTCCACTGAGGAAGGTGCATCCCCGGGCACCAGCTCTACCGGTTCTCCAGGTAGCTCTACCCCGTCTGGTGCTACCGGCTCTCCAGGTAGCTCTACCCCGTCTGGTGCTACTGGCTCTCCAGGTAGCCCCGGCTGGCTCTCCTACCTCTACTGAG | 748 |

Example 18

Methods of Producing and Evaluating GPXTEN; XTEN-Ex4 as Example

A general schema for producing and evaluating GPXTEN compositions is presented in FIG. 6, and forms the basis for the general description of this Example. Using the disclosed methods and those known to one of ordinary skill in the art, together with guidance provided in the illustrative examples, a skilled artesian can create and evaluate a range of GPXTEN fusion proteins comprising, XTENs, GP and variants of GP known in the art. The Example is, therefore, to be construed as merely illustrative, and not limitative of the methods in any way whatsoever; numerous variations will be apparent to the ordinarily skilled artisan. In this Example, a GPXTEN of exendin-4 ("Ex4") linked to an XTEN of the AE family of motifs would be created.

The general schema for producing polynucleotides encoding XTEN is presented in FIGS. 4 and 5. FIG. 5 is a schematic flowchart of representative steps in the assembly of a XTEN polynucleotide construct in one of the embodiments of the invention. Individual oligonucleotides 501 are annealed into sequence motifs 502 such as a 12 amino acid motif ("12-mer"), which is subsequently ligated with an oligo containing BbsI, and KpnI restriction sites 503. The motif libraries can be limited to specific sequence XTEN families; e.g., AD, AE, AF, AG, AM, or AQ sequences of Table 1. In this case, the motifs of the AE family would be used as the motif library, which are annealed to the 12-mer to create a "building block" length; e.g., a segment that encodes 36 amino acids. The gene encoding the XTEN sequence can be assembled by ligation and multimerization of the "building blocks" until the desired length of the XTEN gene 504 is achieved. As illustrated in FIG. 5, the XTEN length in this case is 48 amino acid residues, but longer lengths can be achieved by this process. For example, multimerization can be performed by ligation, overlap extension, PCR assembly or similar cloning techniques known in the art. The XTEN gene can be cloned into a stuffer vector. In the example illustrated in FIG. 5, the vector can encode a Flag sequence 506 followed by a stuffer sequence that is flanked by BsaI, BbsI, and KpnI sites 507 and a GP gene (e.g., exendin-4) 508, resulting in the gene encoding the GPXTEN 500, which, in this case encodes the fusion protein in the configuration, N- to C-terminus, XTEN-Ex4.

Figure 8:
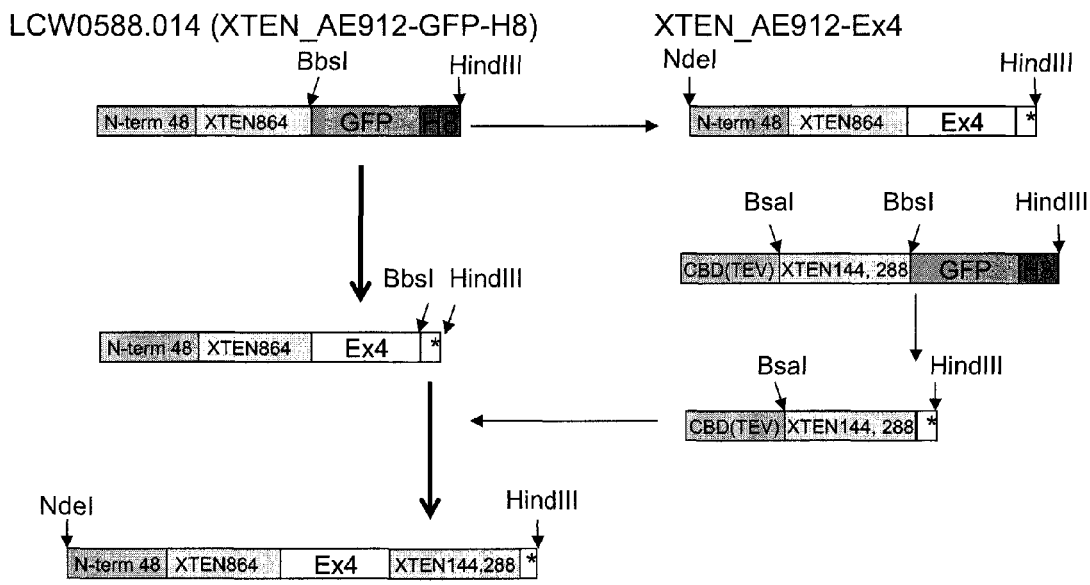
FIG. 8 is a schematic representation of the step-wise construction of GPXTEN genes that contain N-terminal XTEN encoding sequences linked to a sequence encoding exendin-4 (Ex4) and the subsequent linkage of sequences encoding either 144 or 288 XTEN linked to the C-terminus of XTEN, as described in Example 18.

DNA sequences encoding Ex4 (or another candidate GP) can be conveniently obtained by standard procedures known in the art from a cDNA library prepared from an appropriate cellular source, from a genomic library, or may be created synthetically (e.g., automated nucleic acid synthesis) using DNA sequences obtained from publicly available databases, patents, or literature references. A gene or polynucleotide encoding the Ex4 portion of the protein can be then be cloned into a construct, such as those described herein, which can be a plasmid or other vector under control of appropriate transcription and translation sequences for high level protein expression in a biological system. A second gene or polynucleotide coding for the XTEN portion (in the case of FIG. 5 illustrated as an AE with 48 amino acid residues) can be genetically fused to the nucleotides encoding the N-terminus (or its complement) of the Ex4 gene by cloning it into the construct adjacent and in frame with the gene coding for the Ex4, through a ligation or multimerization step. Additional nucleotides encoding longer length XTEN can be ligated to the XTEN-Ex4 gene to achieve the desired length of the XTEN component. In addition, polynucleotides encoding XTEN can be ligated adjacent and in frame to the nucleotides encoding the C-terminus (or its complement) of the Ex4 sequence, resulting in a gene that encodes a GPXTEN with XTEN linked to both the N- and C-terminus of the exendin-4 glucose regulating peptide, including the optimized N-terminal sequence (NTS), as illustrated in FIG. 8. In this manner, a chimeric DNA molecule coding for (or complementary to) the XTEN-Ex4 GPXTEN fusion protein would be generated within the construct. The construct can be designed in different configurations to encode the various permutations of the fusion partners as a monomeric polypeptide. For example, the gene can be created to encode the fusion protein in the order (N- to C-terminus): Ex4-XTEN; XTEN-Ex4; Ex4-XTEN-Ex4; XTEN-Ex4-XTEN; as well as multimers of the foregoing. Optionally, this chimeric DNA molecule may be transferred or cloned into another construct that is a more appropriate expression vector. At this point, a host cell capable of expressing the chimeric DNA molecule would be transformed with the chimeric DNA molecule. The vectors containing the DNA segments of interest can be transferred into an appropriate host cell by well-known methods, depending on the type of cellular host, as described supra.

Host cells containing the XTEN-Ex4 expression vector would be cultured in conventional nutrient media modified as appropriate for activating the promoter. The culture conditions, such as temperature, pH and the like, are those previously used with the host cell selected for expression, and will be apparent to the ordinarily skilled artisan. After expression of the fusion protein, cells would be harvested by centrifugation, disrupted by physical or chemical means, and the resulting crude extract retained for purification of the fusion protein, as described below. For GPXTEN compositions secreted by the host cells, supernatant from centrifugation would be separated and retained for further purification.

Gene expression would be measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, gene expression would be measured by immunological of fluorescent methods, such as immunohistochemical staining of cells to quantitate directly the expression of gene product. Antibodies useful for immunohistochemical staining and/or assay of sample fluids may be either monoclonal or polyclonal, and may be prepared in any mammal. Conveniently, the antibodies may be prepared against the Ex4 sequence polypeptide using a synthetic peptide based on the sequences provided herein or against exogenous sequence fused to Ex4 and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

The XTEN-Ex4 polypeptide product would be purified via methods known in the art. Procedures such as gel filtration, affinity purification, salt fractionation, ion exchange chromatography, size exclusion chromatography, hydroxyapatite adsorption chromatography, hydrophobic interaction chromatography, or gel electrophoresis are all techniques that may be used in the purification. Specific methods of purification are described in Robert K. Scopes, Protein Purification: Principles and Practice, Charles R. Castor, ed., Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994).

As illustrated in FIG. 6, the isolated XTEN-Ex4 fusion proteins would then be characterized for their chemical and activity properties. Isolated fusion protein would be characterized, e.g., for sequence, purity, apparent molecular weight, solubility and stability using standard methods known in the art. The fusion protein meeting expected standards would then be evaluated for activity, which can be measured in vitro or in vivo, using one or more assays disclosed herein; e.g., the assays of the Examples or Table 35.

In addition, the XTEN-Ex4 fusion protein would be administered to one or more animal species to determine standard pharmacokinetic parameters, as described in Example 25.

By the iterative process of producing, expressing, and recovering XTEN-Ex4 constructs, followed by their characterization using methods disclosed herein or others known in the art, the GPXTEN compositions comprising Ex4 and an XTEN can be produced and evaluated by one of ordinary skill in the art to confirm the expected properties such as enhanced solubility, enhanced stability, improved pharmacokinetics and reduced immunogenicity, leading to an overall enhanced therapeutic activity compared to the corresponding unfused Ex4. For those fusion proteins not possessing the desired properties, a different sequence can be constructed, expressed, isolated and evaluated by these methods in order to obtain a composition with such properties.

Example 19

Construction of Exendin-4_XTEN Genes and Vectors

Figure 7:
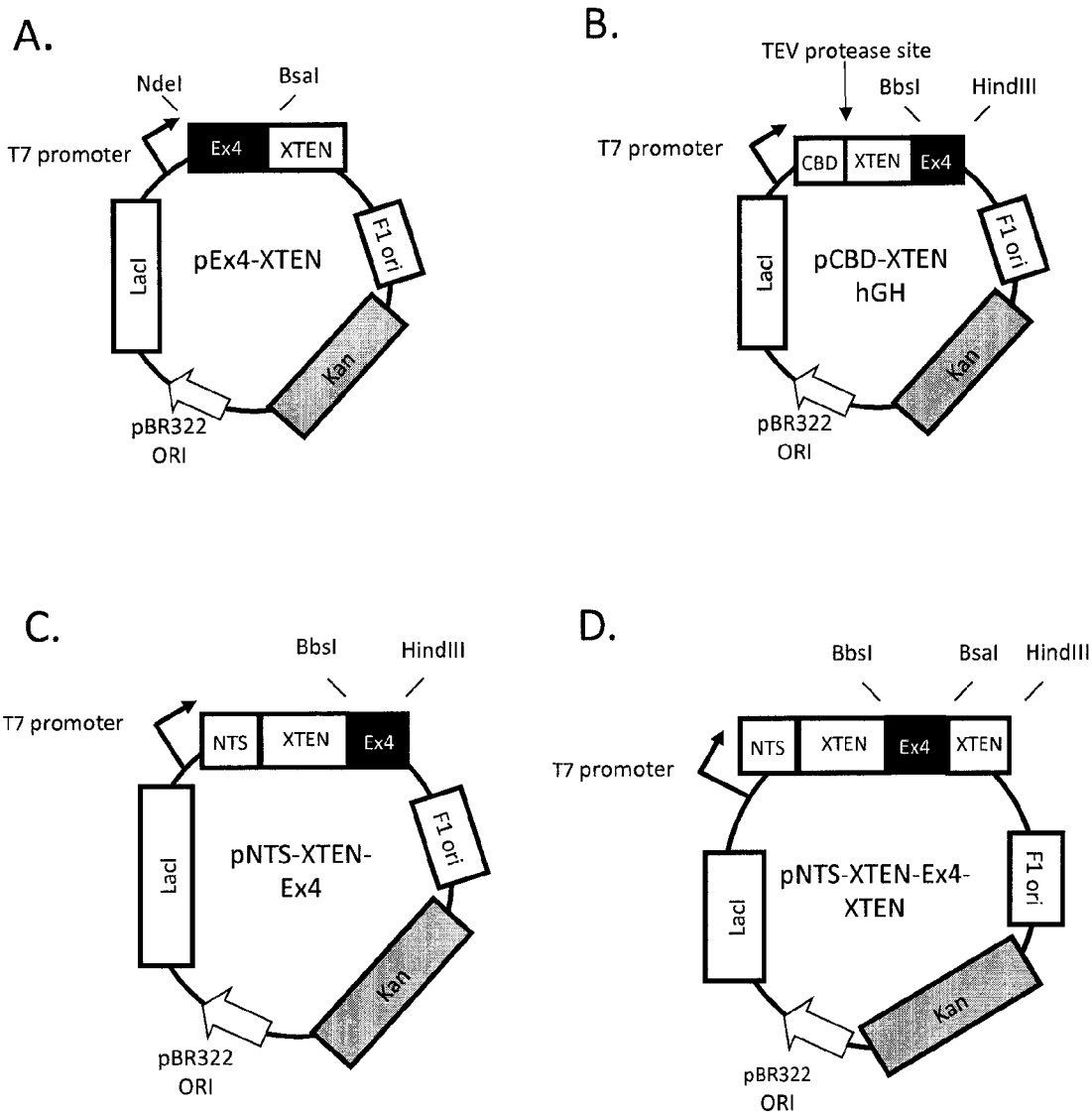
FIG. 7 is a schematic representation of the design of Ex4XTEN expression vectors with different processing strategies.

A cellulose binding domain (CBD) was assembled with an exendin-4 encoding sequence and genetically fused to an encoding sequence for the N-terminus of XTEN. The CBD is immediately followed by a tobacco etch virus (TEV) protease cleavage site (ENLYFQ (SEQ ID NO: 749)) for processing the native N-terminus of exendin-4. The CBD-Exendin-4 fragment was assembled by amplifying the CBD gene using a 3' oligonucleotide that fuses the exendin-4 sequence preceded by the TEV cleavage site resulting in an in frame fusion of the exendin-4 to the C-terminus of the CBD gene. The full-length CBD-exendin-4 was then amplified by polymerase chain reaction (PCR), which introduced NdeI and BbsI restriction sites that are compatible with the NdeI and BsaI sites that flank the stuffer in the XTEN destination vector (FIG. 7A). The prXTEN plasmid is a pET30 derivative from Novagen in which a Stuffer-XTEN sequence has been inserted under control of the T7 promoter, where Stuffer can be a sequence encoding either green fluorescent protein (GFP) or CBD, depending on the specific plasmid used. The XTEN can be any length from 36 to 864 amino acids or greater again depending on the specific plasmid used. Constructs were generated by replacing the stuffer sequence in prXTEN with the CBD-exendin-4-encoding fragment (FIG. 7B). The prXTEN features a T7 promoter upstream of the stuffer sequence, and an XTEN sequence fused in-frame downstream of the stuffer sequence. The XTEN sequence employed in this specific example encodes AE864 with 864 amino acids. The stuffer fragment was removed by restriction digest using NdeI and BsaI endonucleases. Restriction digested CBD-exendin-4 fragments were ligated into the cleaved pXTEN vector using T4 DNA ligase and electroporated into BL21(DE3) Gold (Stratagene). Transformants were screened by DNA miniprep and the desired construct was confirmed by DNA sequencing. The final vector yields the CBD_exendin-4_XTEN gene under the control of a T7 promoter.

Example 20

Construction of Glucagon-XTEN Genes and Vectors

A cellulose binding domain (CBD) was assembled with a glucagon encoding sequence and genetically fused to an encoding sequence for the XTEN. The CBD is immediately followed by a tobacco etch virus (TEV) protease cleavage site (ENLYFQ (SEQ ID NO: 750)) for processing the native N-terminus of glucagon. The CBD-Glucagon fragment was assembled by amplifying the CBD gene using a 3' oligonucleotide that fuses the glucagon sequence preceded by the TEV cleavage site resulting in an in frame fusion of the Glucagon to the C-terminus of the CBD gene. The full-length CBD-Glucagon was then amplified by polymerase chain reaction (PCR), which introduced NdeI and BbsI restriction sites that are compatible with the NdeI and BsaI sites that flank the stuffer in the XTEN destination vector (pXTEN; FIG. 9A). The pXTEN plasmid is a pET30 derivative from Novagen in which a Stuffer-XTEN sequence has been inserted under control of the T7 promoter, where Stuffer can be a sequence encoding either green fluorescent protein (GFP) or CBD, depending on the specific plasmid used. The XTEN can be any length from 36 to 875 amino acids or greater again depending on the specific plasmid used. Constructs were generated by replacing the stuffer sequence in prXTEN with the CBD-glucagon-encoding fragment. The pXTEN features a T7 promoter upstream of the stuffer sequence, and an XTEN sequence fused in-frame downstream of the stuffer sequence. The XTEN sequences employed in this specific example belong to the Y family of XTEN and encode lengths that include 36, 72, 144, 288, and 576 amino acids. The stuffer fragment was removed by restriction digest using NdeI and BsaI endonucleases. Restriction digested CBD-Glucagon fragments were ligated into the cleaved prXTEN vector using T4 DNA ligase and electroporated into BL21(DE3) Gold (Stratagene). Transformants were screened by DNA miniprep and the desired construct was confirmed by DNA sequencing. The final vector yields the CBD_glucagon_XTEN gene under the control of a T7 promoter. The resulting DNA sequences can encode glucagon linked to XTEN lengths of 36, 72, 144, 288, and 576 amino acids, respectively.

Example 21

Purification and Characterization of Gcg-XTEN

The GPXTEN of glucagon linked to XTEN was produced recombinantly in E. coli and purified to homogeneity using three column steps. The final construct comprised the gene encoding the cellulosome anchoring protein cohesion region cellulose binding domain (CBD) from C. thermocellum (accession #ABN54273), a tobacco etch virus (TEV) protease recognition site (ENLYFQ (SEQ ID NO: 750)), the glucagon sequence, and the appropriate XTEN sequence under control of a T7 promoter. Briefly, protein expression was induced by addition of 1 mM IPTG to a log phase culture of BL21-Gold (DE3) E. coli carrying the expression plasmid. TEV protease was added to heat-treated cell lysate containing Gcg-XTEN to remove the CBD sequence and generate the native N-terminus of glucagon. The cleaved protein was then purified over DE52, MacroCap Q, and Butyl Sepharose FF columns. The final material was formulated in 20 mM Tris pH 7.5, 135 mM NaCl and sterile filtered using a 0.22 micron filter. Expression was determined to be approximately 7 mg protein per gram wet cell weight (~100 mg/L at final OD~4) and overall purification yield was approximately 60%.

Size exclusion chromatography (SEC) was performed using a TSK-Gel, G3000 SWXL, 7.8×300 mm HPLC column (Tosoh Bioscience) connected to an HPLC system equipped with an autosampler and UV/VIS detector (Shimadzu). The system was equilibrated in phosphate buffered saline (PBS) at a flow rate of 0.7 mL/min at ambient temperature. For column calibration, a gel filtration standard (BioRad, cat#151-1901) was used. For sample analysis, 20 µl of 1 mg/ml Gcg-XTEN was injected and absorbance was monitored for 20 min using OD214 nm.

Figure 19:
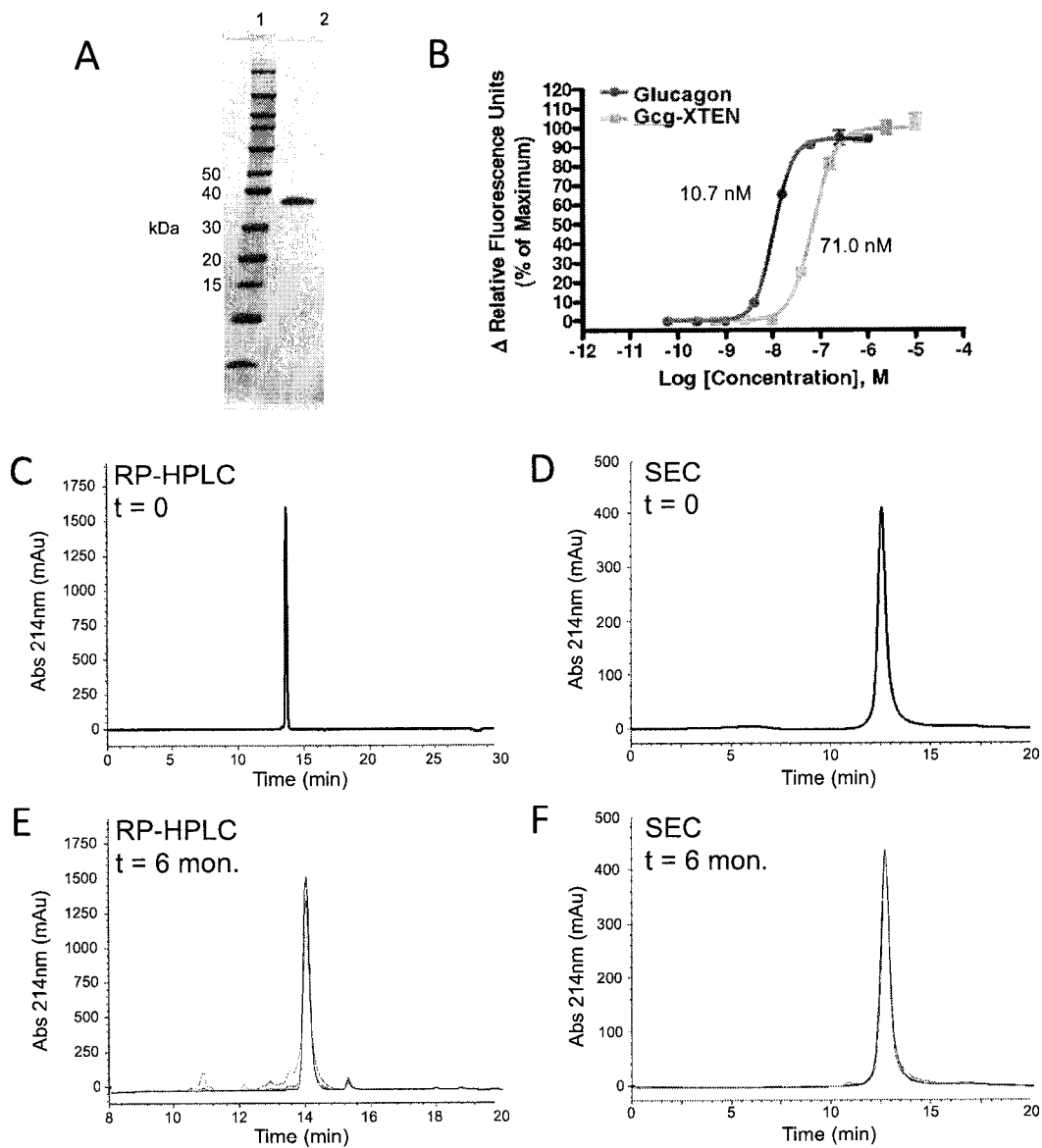
FIG. 19 shows results of studies of the biophysical characterization and stability of Gcg-XTEN (see Example 21 for experimental details).

Reverse phase C18 chromatography (RPC18) was performed using a Phenomenex Gemini 5 µm C18-110A, 4.6× 100 mm column (Phenomenex) connected to an HPLC system equipped with an autosampler and UV/VIS detector (Shimadzu). Buffer A was 0.1% TFA in water and Buffer B was 0.1% TFA in 100% acetonitrile. The system was run with a combined flowrate of 1 ml/min. The column was equilibrated in 5% Buffer B at 35° C. The chromatographic separation of Gcg-XTEN was achieved by a linear gradient from 5% to 95% B over 15 minutes. For sample analysis, 10 µl of 1 mg/ml Gcg-XTEN was injected and absorbance was monitored using OD214 nm. Sample analyses were performed by Millipore's GPCRProfiler® service using a transfected GcgR cell line (Cat# HTS112C). Calcium flux was monitored in real-time by FLIPR analysis after addition of serial dilutions of Gcg-XTEN or synthetic glucagon. The results of the characterization and stability assays are shown in FIG. 19. The data show that Gcg-XTEN is a homogeneous, well-defined chemical entity. In addition, the solubility and stability of the final protein are significantly improved over unmodified glucagon (data not shown).

Example 22

Figure 15:
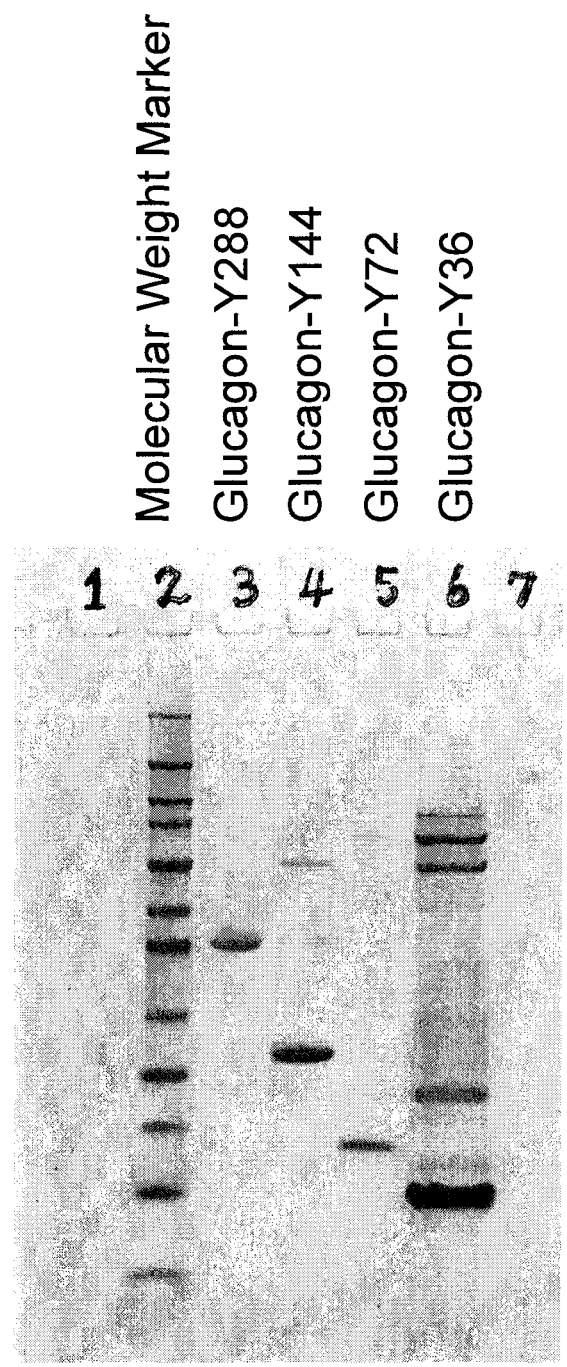
FIG. 15 shows an SDS-PAGE gel confirming expression of glucagon fused to XTEN of various lengths; i.e., Y288, Y144, Y72 and Y36, in comparison to molecular weight standards.
Figure 16:
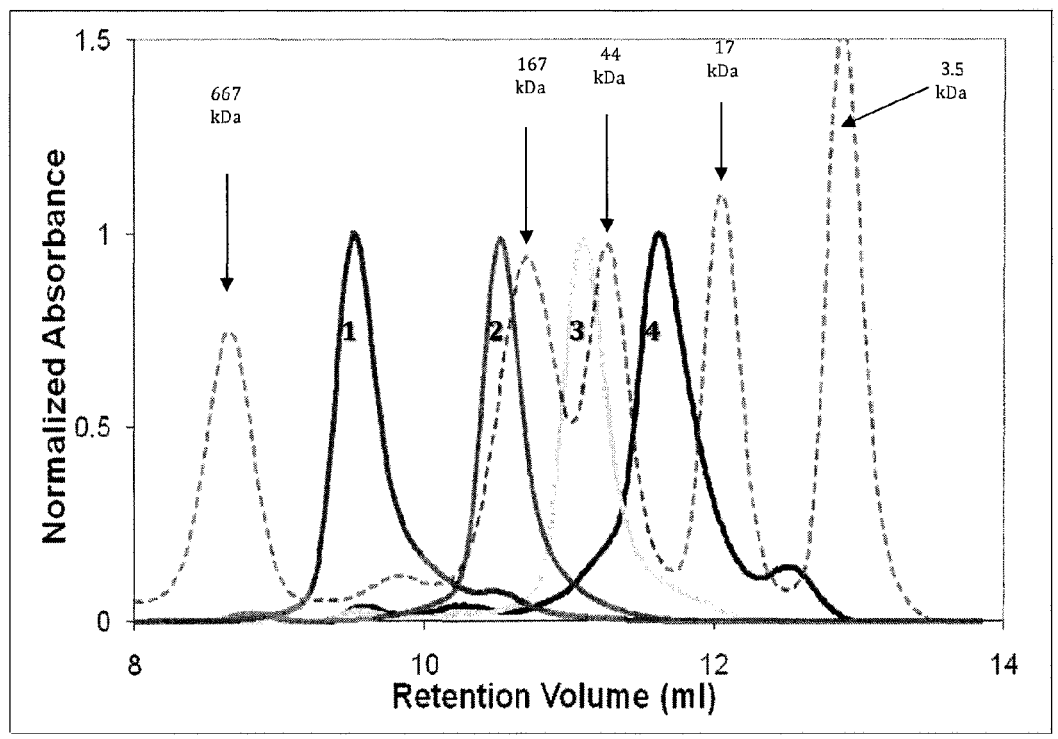
FIG. 16 shows results of a of a size exclusion chromatography analysis of glucagon-XTEN construct samples measured against protein standards of known molecular weight, with the graph output as absorbance versus retention volume, as described in Example 22. The glucagon-XTEN constructs are 1) glucagon-Y288; 2) glucagonY-144; 3) glucagon-Y72; and 4) glucagon-Y36. The results indicate an increase in apparent molecular weight with increasing length of XTEN moiety.

Analytical Size Exclusion Chromatography of XTEN Fusion Proteins with Diverse Payloads Size exclusion chromatography analysis was performed on fusion proteins containing various therapeutic proteins and unstructured recombinant proteins of increasing length. An exemplary assay used a TSKGel-G4000 SWXL (7.8 mm×30 cm) column in which 40 µg of purified glucagon fusion protein at a concentration of 1 mg/ml was separated at a flow rate of 0.6 ml/min in 20 mM phosphate pH 6.8, 114 mM NaCl. Chromatogram profiles were monitored using OD214 nm and OD280 nm. Column calibration for all assays were performed using a size exclusion calibration standard from BioRad; the markers include thyroglobulin (670 kDa), bovine gamma-globulin (158 kDa), chicken ovalbumin (44 kDa), equine myoglobuin (17 kDa) and vitamin B12 (1.35 kDa). Representative chromatographic profiles of Glucagon-Y288, Glucagon-Y144, Glucagon-Y72, Glucagon-Y36 are shown as an overlay in FIG. 16. The data show that the apparent molecular weight of each compound is proportional to the length of the attached XTEN sequence. However, the data also show that the apparent molecular weight of each construct is significantly larger than that expected for a globular protein (as shown by comparison to the standard proteins run in the same assay and by comparison to molecular weight standards shown in the SDS gel of FIG. 15). Based on the SEC analyses for all constructs evaluated, including GPXTEN compositions, the Apparent Molecular Weights, the Apparent Molecular Weight Factor (expressed as the ratio of Apparent Molecular Weight to the calculated molecular weight) and the hydrodynamic radius ($R_H$ in nm) are shown in Table 24. The results indicate that incorporation of different XTENs of 576 amino acids or greater confers an apparent molecular weight for the fusion protein of approximately 339 kDa to 760, and that XTEN of 864 amino acids or greater confers an apparent molecular weight greater than approximately 800 kDA. The results of proportional increases in apparent molecular weight to actual molecular weight were consistent for fusion proteins created with XTEN from several different motif families; i.e., AD, AE, AF, AG, and AM, with increases of at least four-fold and ratios as high as about 17-fold. Additionally, the incorporation of XTEN fusion partners with 576 amino acids or more into fusion proteins with the various payloads (and 288 residues in the case of glucagon fused to Y288) resulted with a hydrodynamic radius of 7 nm or greater; well beyond the glomerular pore size of approximately 3-5 nm. Accordingly, it is concluded that fusion proteins comprising growth and XTEN would have reduced renal clearance, contributing to increased terminal half-life and improving the therapeutic or biologic effect relative to a corresponding un-fused biologic payload protein.

TABLE 24

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
|---|---|---|---|---|---|---|
| AC14 | Y288 | Glucagon | 28.7 | 370 | 12.9 | 7.0 |
| AC28 | Y144 | Glucagon | 16.1 | 117 | 7.3 | 5.0 |
| AC34 | Y72 | Glucagon | 9.9 | 58.6 | 5.9 | 3.8 |
| AC33 | Y36 | Glucagon | 6.8 | 29.4 | 4.3 | 2.6 |
| AC89 | AF120 | Glucagon | 14.1 | 76.4 | 5.4 | 4.3 |

TABLE 24-continued

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
|---|---|---|---|---|---|---|
| AC88 | AF108 | Glucagon | 13.1 | 61.2 | 4.7 | 3.9 |
| AC73 | AF144 | Glucagon | 16.3 | 95.2 | 5.8 | 4.7 |
| AC53 | AG576 | GFP | 74.9 | 339 | 4.5 | 7.0 |
| AC39 | AD576 | GFP | 76.4 | 546 | 7.1 | 7.7 |
| AC41 | AE576 | GFP | 80.4 | 760 | 9.5 | 8.3 |
| AC52 | AF576 | GFP | 78.3 | 526 | 6.7 | 7.6 |
| AC85 | AE864 | Exendin-4 | 83.6 | 938 | 11.2 | 8.9 |
| AC114 | AM875 | Exendin-4 | 82.4 | 1344 | 16.3 | 9.4 |
| AC143 | AM875 | hGH | 100.6 | 846 | 8.4 | 8.7 |
| AC227 | AM875 | IL-1ra | 95.4 | 1103 | 11.6 | 9.2 |
| AC228 | AM1296 | IL-1ra | 134.8 | 2286 | 17.0 | 10.5 |

Example 23

Pharmacokinetics of Extended Polypeptides Fused to GFP in Cynomolgus Monkeys

Figure 26:
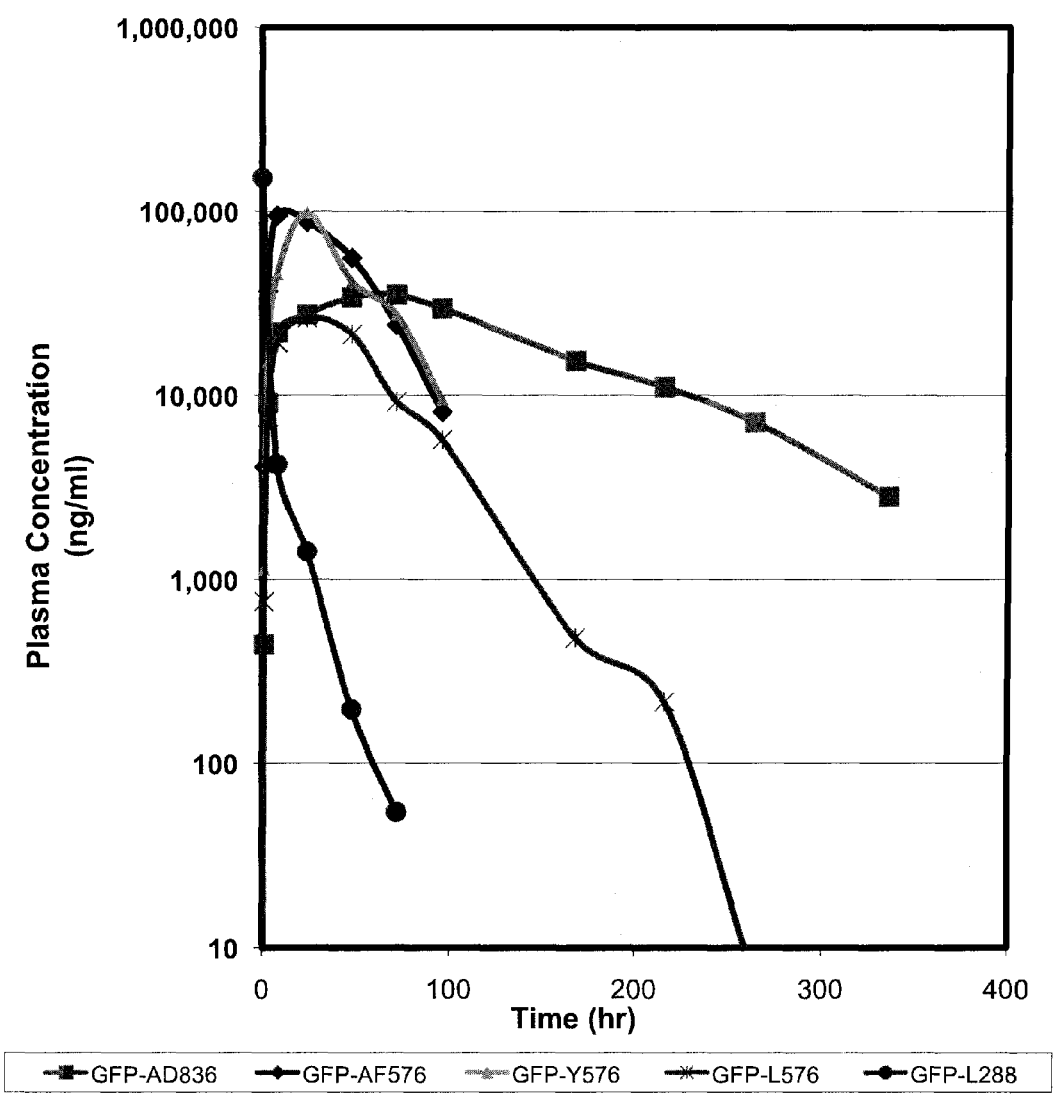
FIG. 26 shows the results of a pharmacokinetic study in cynomolgus monkeys testing the effects of XTEN length with different compositions of GFP linked to XTEN administered either subcutaneously or intravenously, as described in Example 23. The compositions were GFP-L288, GFP-L576, GFP-AF576, GFP-Y576 and AD836-GFP. Results are presented as the plasma concentration versus time (h) after dosing.

The pharmacokinetics of GFP-L288, GFP-L576, GFP-XTEN_AF576, GFP-XTEN_Y576 and XTEN_AD836-GFP were tested in cynomolgus monkeys to determine the effect of composition and length of the unstructured polypeptides on PK parameters. Blood samples were analyzed at various times after injection and the concentration of GFP in plasma was measured by ELISA using a polyclonal antibody against GFP for capture and a biotinylated preparation of the same polyclonal antibody for detection. Results are summarized in FIG. 26. They show a surprising increase of half-life with increasing length of the XTEN sequence. For example, a half-life of 10 h was determined for GFP-XTEN_L288 (with 288 amino acid residues in the XTEN). Doubling the length of the unstructured polypeptide fusion partner to 576 amino acids increased the half-life to 20-22 h for multiple fusion protein constructs; i.e., GFP-XTEN_L576, GFP-XTEN_AF576, GFP-XTEN_Y576. A further increase of the unstructured polypeptide fusion partner length to 836 residues resulted in a half-life of 72-75 h for XTEN_AD836-GFP. Thus, increasing the polymer length by 288 residues from 288 to 576 residues increased in vivo half-life by about 10 h. However, increasing the polypeptide length by 260 residues from 576 residues to 836 residues increased half-life by more than 50 h. These results show that there is a surprising threshold of unstructured polypeptide length that results in a greater than proportional gain in in vivo half-life. Thus, fusion proteins comprising extended, unstructured polypeptides are expected to have the property of enhanced pharmacokinetics compared to polypeptides of shorter lengths.

Example 24

Serum Stability of XTEN

Figure 14:
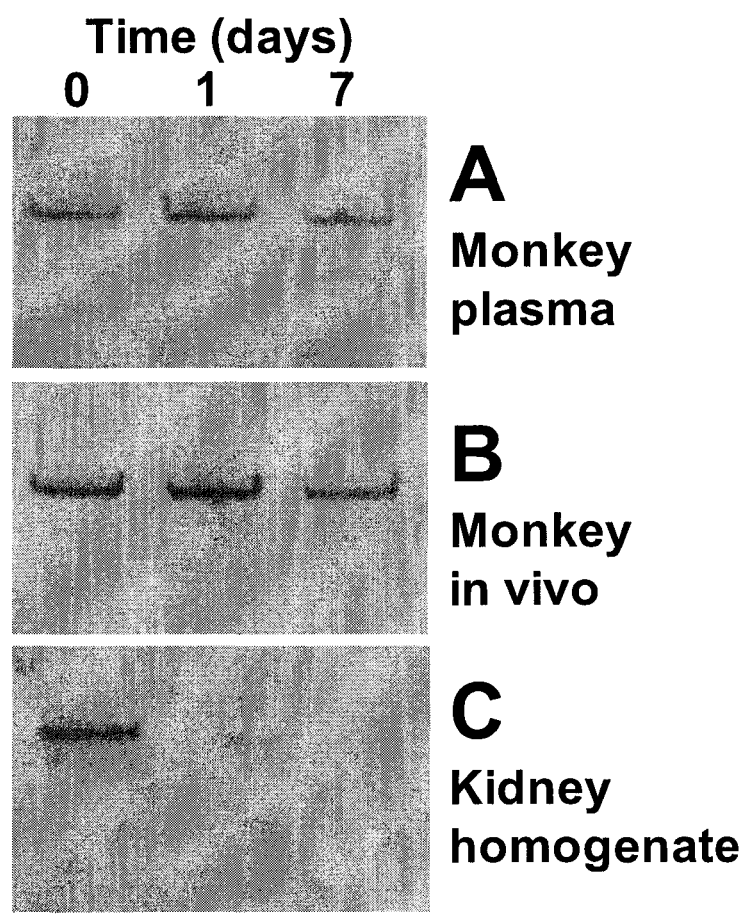
FIG. 14 shows an SDS-PAGE gel of samples from a stability study of the fusion protein of XTEN_AE864 fused to the N-terminus of GFP (see Example 24). The GFP-XTEN was incubated in cynomolgus plasma and rat kidney lysate for up to 7 days at 37° C. In addition, GFP-XTEN administered to cynomolgus monkeys was also assessed. Samples were withdrawn at 0, 1 and 7 days and analyzed by SDS PAGE followed by detection using Western analysis and detection with antibodies against GFP.

A fusion protein containing XTEN_AE864 fused to the N-terminus of GFP was incubated in monkey plasma and rat kidney lysate for up to 7 days at 37° C. Samples were withdrawn at time 0, Day 1 and Day 7 and analyzed by SDS PAGE followed by detection using Western analysis and detection with antibodies against GFP as shown in FIG. 14. The sequence of XTEN_AE864 showed negligible signs of degradation over 7 days in plasma. However, XTEN_AE864 was rapidly degraded in rat kidney lysate over 3 days. The in vivo stability of the fusion protein was tested in plasma samples wherein the GFP-AE864 was immunoprecipitated and analyzed by SDS PAGE as described above. Samples that were withdrawn up to 7 days after injection showed very few signs of degradation. The results demonstrate the resistance of GPXTEN to degradation due to serum proteases; a factor in the enhancement of pharmacokinetic properties of the GPXTEN fusion proteins.

Example 25

PK Analysis of Fusion Proteins Comprising Exendin-4 and XTEN

The GPXTEN fusion protein Ex4_AE864 was evaluated in cynomolgus monkeys in order to determine in vivo pharmacokinetic parameters of the fusion proteins after a single subcutaneous dose.

Methods:

The GPXTEN fusion protein was formulated in 20 mM Tris, pH 7.5, 135 mM NaCl at two different concentrations; 8 mg/mL and 40 mg/mL. Three groups of four monkeys (2 males and 2 females, 2-6 kg) each were dosed at 1 mg/kg (Group 1, 0.125 mL/kg), 1 mg/kg (Group 2, 0.025 mL/kg), or 5 mg/kg (Group 3, 0.125 mL/kg) via bolus injection between the skin and underlying layers of tissue in the scapular region on the back of each animal. Serial blood samples (1 ml±0.5 ml) were drawn over fourteen days from the femoral vein or artery of previously acclimated animals through a syringe with no aesthesia utilizing chair restraint. If necessary, chair restraint was utilized for a maximum of 30 minutes. All animals were fasted overnight prior to dosing and through the first 4 hours of blood sample collection (food was returned within 30 minutes following collection of the last blood sample at the 4 hour collection interval, where applicable). Each blood sample was collected into heparin plasma separator and kept on ice (2° C. to 8° C.) for approximately 5 minutes pending centrifugation. The blood samples were centrifuged (8,000×g for 5 min) and the plasma was transferred into a polypropylene tube. Plasma samples were snap frozen, and stored at approximately −70° C. until assayed. Analysis was performed using a sandwich ELISA format.

Results:

The pharmacokinetic parameters were calculated for the monkeys and the results are tabulated in Table 25. The pharmacokinetic parameters were analyzed using both a naïve pooling of all animals and using a standard two-stage analysis. The results show a difference in absorption of the fusion protein, based on dose volume administered in Group 1 versus Group 2, as evidenced by the Tmax, Cmax, AUC and volume of distribution (Vz) values. However, the calculated half-life values are comparable across the three Groups, and greatly exceed the reported terminal half-life of exenatide of 2.4 h.

TABLE 25

Pharmacokinetic Parameters Calculated from Group Average for Administered GPXTEN.

| Parameter | Group 1 Avg | Group 2 Avg | Group 3 Avg |
|---|---|---|---|
| Tmax | 96 | 24 | 48 |
| Cmax | 4,860 | 3,879 | 18,713 |

TABLE 25-continued

Pharmacokinetic Parameters Calculated from Group Average for Administered GPXTEN.

| Parameter | Group 1 Avg | Group 2 Avg | Group 3 Avg |
|---|---|---|---|
| Lambda_z_lower | 96 | 96 | 96 |
| Lambda_z_upper | 336 | 336 | 336 |
| t1/2_Lambda_z | 83.8 | 76.8 | 74.0 |
| AUCall | 739,850 | 524,615 | 2,445,751 |
| Vz(observed)/F | 579 | 871 | 986 |
| Cl(observed)/F | 4.8 | 7.9 | 9.2 |
| Vz(observed)/F | 148 | 199 | 207 |

Conclusions:

The linking of exendin-4 to XTEN to create a GPXTEN fusion results in significant enhancement of pharmacokinetic parameters for all three formulations, as demonstrated in the primate model, with an increase of at least 30-fold in the half-life.

Example 26

Use of GPXTEN in Diet-Induced Obese Mouse Model

The effects of combination therapy of glucose regulating peptides linked to XTEN were evaluated in a mouse model of diet-induced obesity to confirm the utility of fixed combinations of monomeric fusion proteins as a single GPXTEN composition.

Methods:

The effects of combination therapy of glucagon linked to Y-288-XTEN ("Gcg-XTEN") and exenatide linked to AE576-XTEN ("Ex4-XTEN") or exenatide singly were tested in male C57BL/6J Diet-Induced Obese (DIO) Mice, age 10 weeks old. Mice raised on a 60% high fat diet were randomized into the treatment groups (n=10 per group) Ex4-XTEN864 (10 mg/kg IP Q2D), Ex4-XTEN864 (20 mg/kg IP Q4D), Ex4-XTEN864 (10 mg/kg IP Q2D) plus Gcg-XTEN288 (20 µg/kg IP BID), and Ex4-XTEN864 (20 mg/kg IP Q4D) plus Gcg-XTEN288 (40 µg/kg IP Q1D). A placebo group (n=10) treated with 20 mM Tris pH 7.5, 135 mM NaCl IP Q1D was tested in parallel. All groups were dosed continuously for 28 days. Body weight was monitored at regular intervals throughout the study and fasting blood glucose was measured before and after the treatment period. Groups were dosed continuously for a 28 day treatment period. Body weight was monitored continuously throughout the study and fasting blood glucose was measured before and after the treatment period, and lipid levels were determined after the treatment period.

Figure 23:
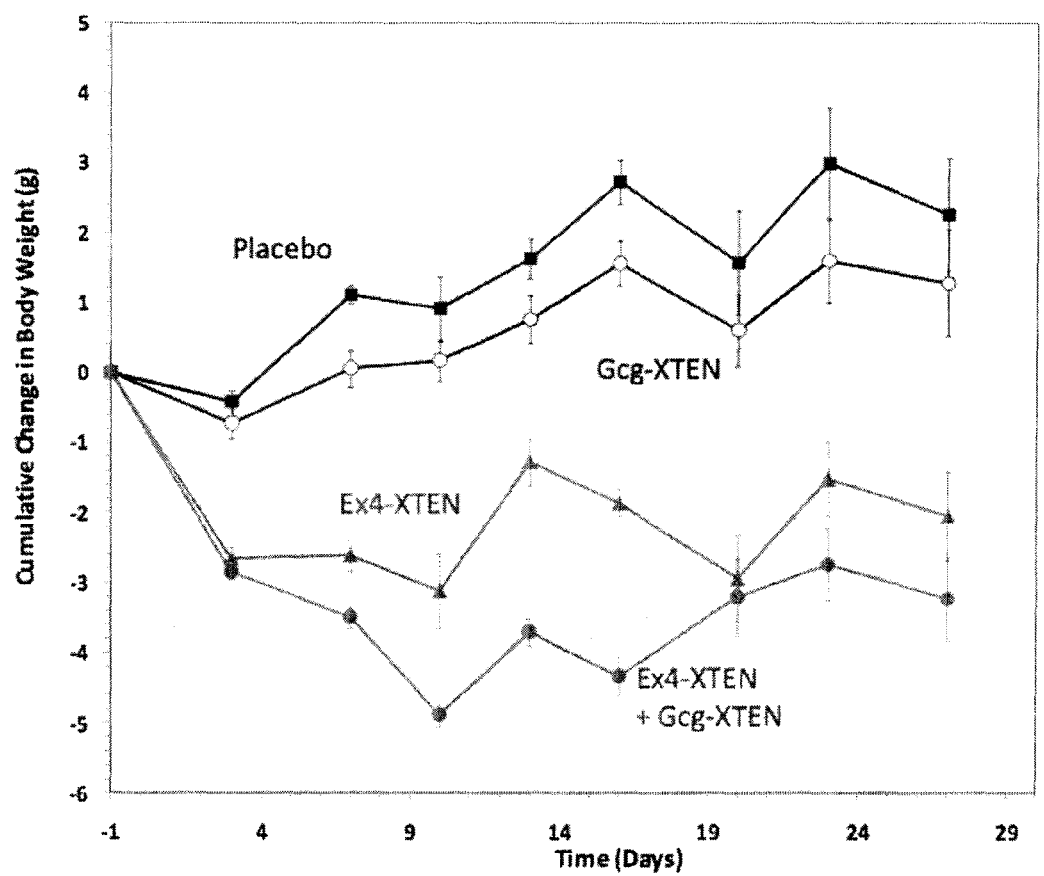
FIG. 23 shows body weight results from a pharmacodynamic and metabolic study using a combination of two GPX-TEN fusion proteins; i.e., glucagon linked to Y288 (Gcg-XTEN) and exendin-4 linked to AE864 (Ex4-XTEN) to evaluate the combination for efficacy in a diet-induced obesity model in mice (see Example 26 for experimental details). The graph shows change in body weight in Diet-Induced Obese mice over the course of 28 days continuous drug administration. Values shown are the average+/–SEM of 10 animals per group (20 animals in the placebo group).
Figure 24:
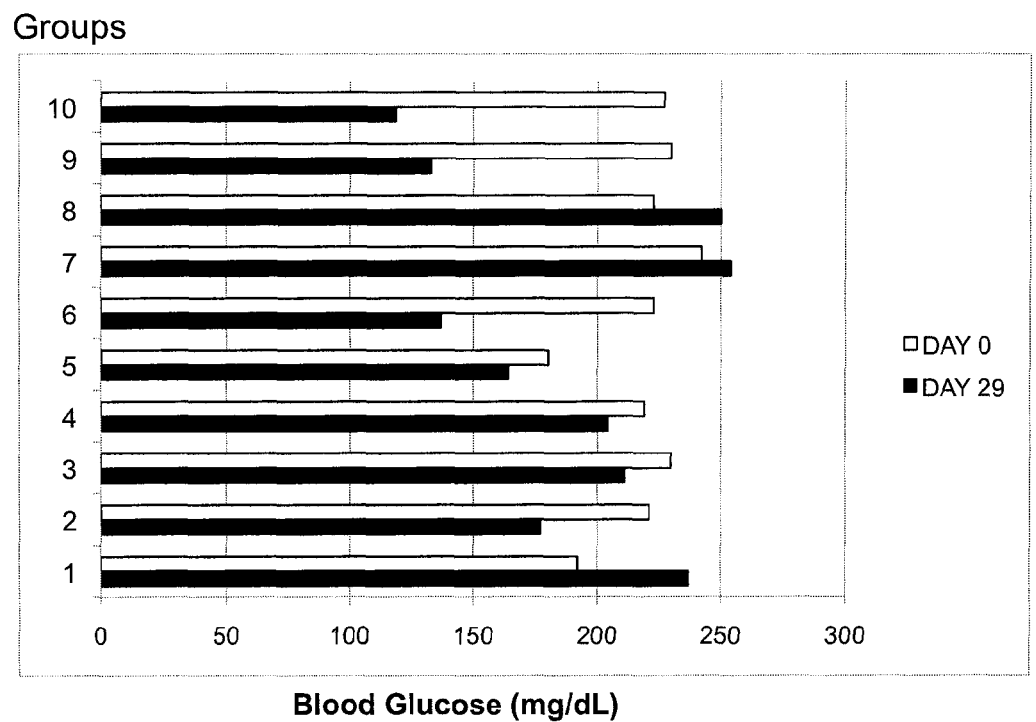
FIG. 24 shows change in fasting glucose levels from a pharmacodynamic and metabolic study using single and combinations of two GPXTEN fusion proteins; i.e., glucagon linked to Y288 (Gcg-XTEN) and exendin-4 linked to AE864 (Ex4-XTEN) in a diet-induced obesity model in mice (see Example 26 for experimental details). Groups are as follows: Gr. 1 Tris Vehicle; Gr. 2 Ex4-AE576, 10 mg/kg; Gr. 3 Ex4-AE576, 20 mg/kg; Gr. 4 Vehicle, 50% DMSO; Gr. 5 Exenatide, 30 µg/kg/day; Gr. 6 Exenatide, 30 uL/kg/day+Gcg-Y288 20 µg/kg; Gr. 7 Gcg-Y288, 20 µg/kg; Gr. 8 Gcg-Y288, 40 µg/kg; Gr. 9 Ex4-AE576 10 mg/kg+Gcg-Y288 20 µg/kg; Gr. 10 Gcg-Y288 40 µg/kg+Ex4-AE576 20 mg/kg. The graph shows the change in fasting blood glucose levels in Diet-Induced Obese mice over the course of 28 days continuous drug administration. Values shown are the average+/–SEM of 10 animals per group (20 animals in the placebo group).
Figure 25:
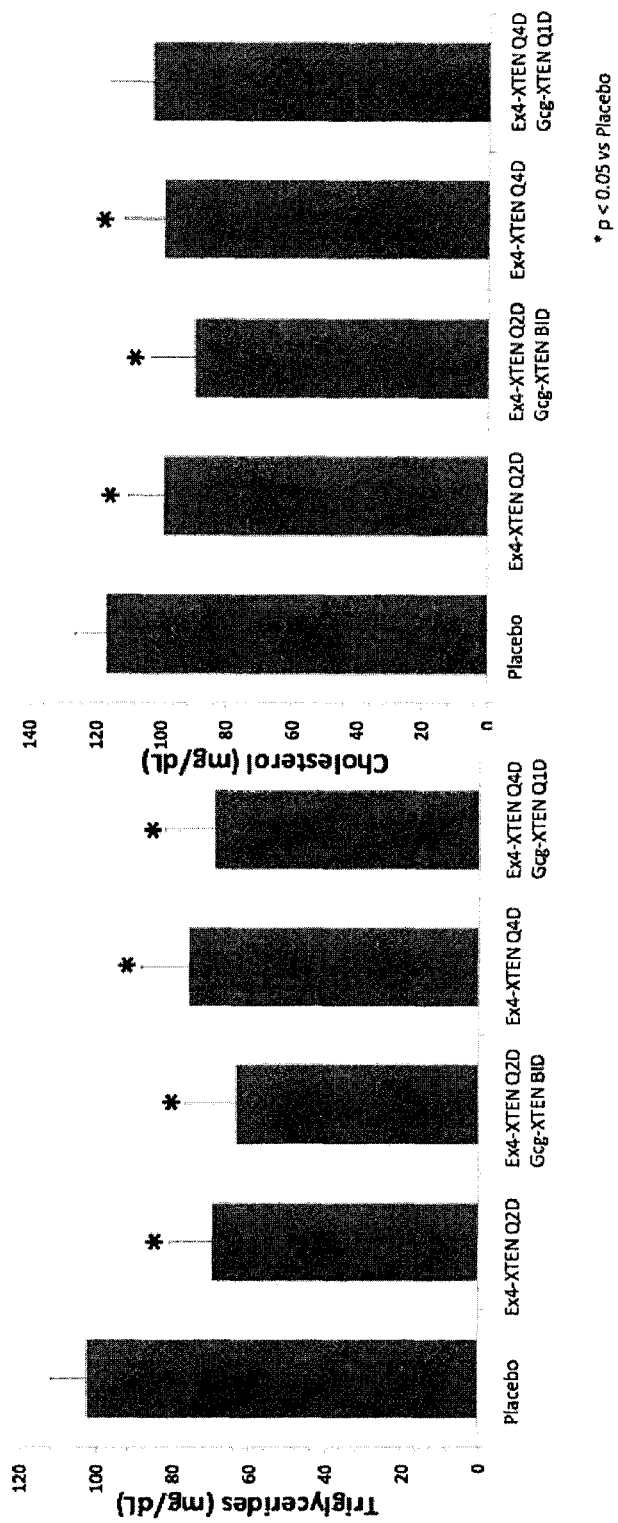
FIG. 25 shows the triglyceride and cholesterol levels in Diet-Induced Obese mice after 28 days continuous drug administration of Gcg-XTEN and exendin-4, either singly or in combination (see Example 26 for experimental details). Values shown are the average+/–SEM of 10 animals per group.

Results:

The results are shown in FIGS. 23-25. The data indicate that continuous dosing for one month yielded a significant reduction in weight gain in the animals treated with Gcg-XTEN alone and Ex4-XTEN alone, relative to placebo over the course of the study. In addition, animals dosed with Ex4-XTEN or Gcg-XTEN and Ex4-XTEN concurrently showed a statistically significantly greater weight loss compared to Gcg-XTEN administered alone and compared to placebo. The toxic effects of glucagon administration are well documented. The maximum no-effect dose for glucagon in rats and beagle dogs has recently been reported as 1 mg/kg/day was regarded as a clear no-toxic-effect-level in both species (Eistrup C, Glucagon produced by recombinant DNA technology: repeated dose toxicity studies, intravenous administration to CD rats and beagle dogs for four weeks. Pharmacol Toxicol. 1993 August; 73(2):103-108).

The data also show that continuous dosing for one month yielded a significant reduction in fasting blood glucose for the animals treated with Ex4-XTEN alone relative to placebo, but not for animals treated with Gcg-XTEN alone. However, animals dosed with both Gcg-XTEN and exenatide concurrently showed a statistically significantly greater reduction in fasting blood glucose levels compared to either glucose regulating peptide administered alone. Of note, the doses of Gcg-XTEN composition that resulted in the beneficial effects in combination with Ex4-XTEN were 20 and 40 µg/kg (complete fusion protein composition weight); at least 25-fold lower than the no-effect dose reported for glucagon alone in a rodent species. In addition, mice receiving the GP had reductions in triglycerides and cholesterol levels, compared to placebo.

Conclusions:

The data support the conclusion that combination therapy with two fusion proteins of two glucose regulating peptides such as exendin-4 and glucagon, each linked to an XTEN, can result in a synergistic beneficial effect over that seen with a single glucose regulating peptide such that administration of a combination composition can be tailored to reduce frequency of dosing or dosage compared to administration of a single biologic in order to reduce the threat of toxicity or unacceptable side effects.

Example 27

PK Analysis of Ex4-XTEN GPXTEN in Cynomolgus Monkeys

The pharmacokinetics of Ex4-AE864 GPXTEN was determined in cynomolgus monkeys (three per group) with the GPXTEN administered by subcutaneous or intravenous injections of GPXTEN at 0.5 mg/kg over a 1 minute period. Plasma samples were collected at various time points up to 14 days after injection and analyzed by ELISA for determination of both test article serum concentration and immunogenicity. No anti-test article antibody response was observed for Ex4-AE864 in any animal after administration. Sandwich ELISA was carried out by >12 h immobilization of 100 ng capture antibody (rabbit anti-exenatide, Peninsula Laboratories, San Carlos, Calif.) to each well in a polystyrene microtiter plate (Costar 3690, Corning Inc, Corning, N.Y.), followed by blocking with 3% bovine serum albumin (BSA). After 3 washes with PBS, plasma samples were serially titrated across the plate in PBS containing 1% BSA and 0.5% Tween 20. After a 2 hour incubation and washing, the samples were probed by the addition of biotinylated IgG (rabbit anti-exenatide biotinylated in house, Peninsula Laboratories, San Carlos, Calif.) to each well. After incubation and washing, plates were developed by incubation with horseradish peroxidase-conjugated streptavidin (Thermo Fisher Scientific, Rockford, Ill.) followed by tetramethylbenzidine substrate (Neogen Corporation, Lexington, Ky.), then quenched with 0.2 N $H_2SO_4$ and read at 450 nm. Non-compartmental pharmacokinetic parameters were calculated using the WinNonLin program, Version 2.1 (Pharsight Corporation, Mt. View, Calif.).

Figure 17:
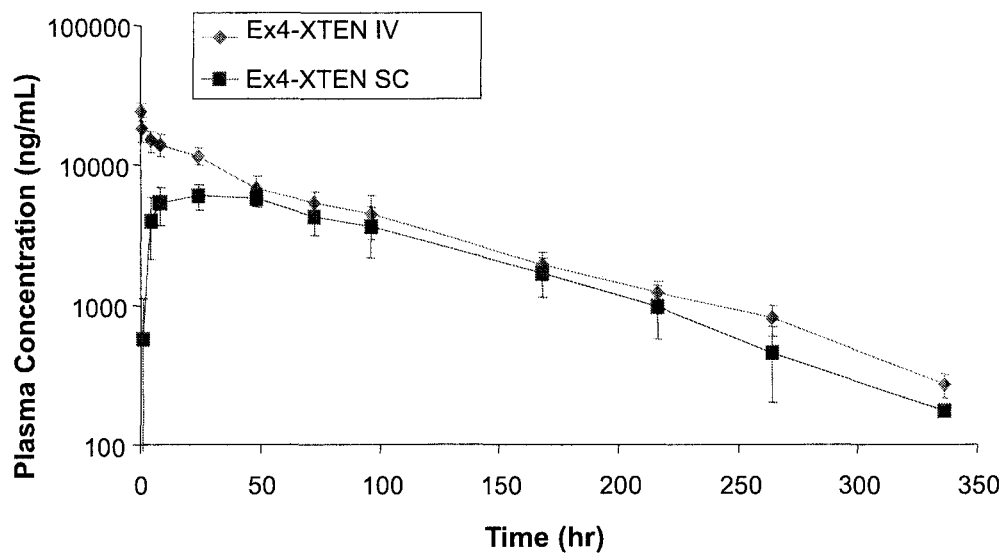
FIG. 17 shows the pharmacokinetic results of the GPX-TEN Ex4-AE864 administered to cynomolgus monkeys by the subcutaneous and intravenous routes (see Example 27 for experimental details).

The results are depicted in FIG. 17. Terminal half-life of this formulation of the construct was 60 hours, with 80% bioavailability from a subcutaneous injection. This compares to the reported half-life of 2.4 h for Byetta®, a commercial version of exendin-4. Importantly, a slow absorption phase, which appears to be characteristic of XTEN fusion proteins, was noted after subcutaneous injection. The absorption phase resulted in a Cmax between 24-48 hours after injection and an essentially flat serum concentration profile for ~100 hours before reaching a linear elimination phase.

Conclusions:

It can be concluded from the results that addition of an XTEN to a glucose-regulating peptide, such as exendin-4, can greatly increase the terminal half-life compared to the peptide not linked to XTEN, and enhance other pharmacokinetic parameters, as well.

Example 28

Figure 18:
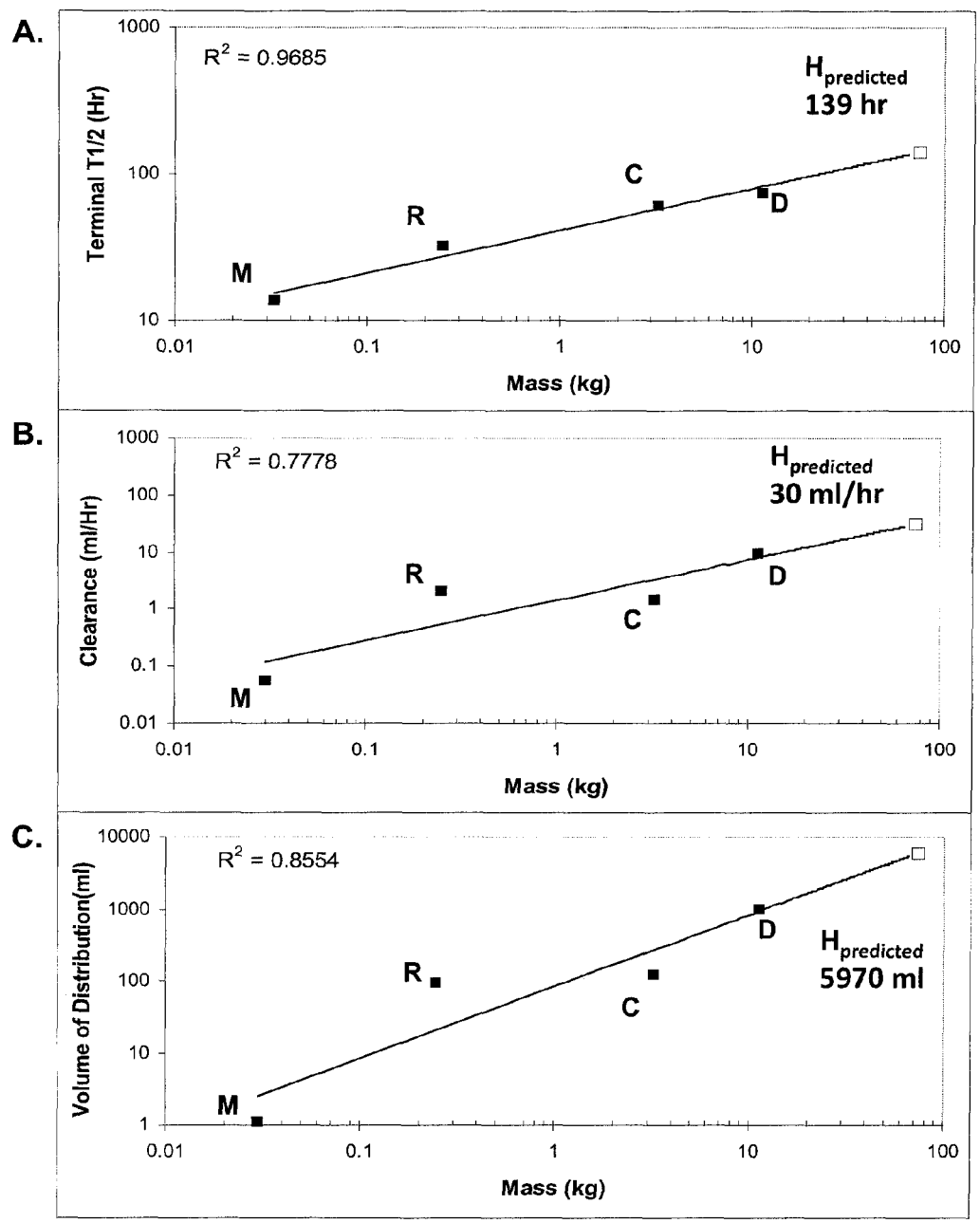
FIG. 18 illustrates allometric scaling results for predicted human response to Ex4-XTEN_AE864 based on measured results from four animal species; i.e., mice, rats, cynomolgus monkeys and dogs, as described in Example 28.

PK Analysis of Ex4-XTEN GPXTEN in Multiple Species and Predicted Human Half-Life To determine the predicted pharmacokinetic profile in humans of a therapeutic protein fused to XTEN, studies were performed using exendin-4 fused to the AE864 XTEN as a single fusion polypeptide. The Ex4-XTEN construct was administered to four different animal species at 0.5-1.0 mg/kg, subcutaneously and intravenously. Serum samples were collected at intervals following administration, with serum concentrations determined using standard methods. The half-life for each species was determined, and is tabulated in Table 26. The results were used to predict the human half-life using allometric scaling of terminal half-life, volume of distribution, and clearance rates based on average body mass. FIG. 18A shows a plot of measured terminal half-life versus body mass in the animal species, with a predicted $T_{1/2}$ in a 75 kg human of 140 h, compared to the reported half-life of exenatide of 2.4 h (Bond, A. Proc (Bayl Univ Med Cent) 19(3): 281-284. (2006)). FIG. 18B shows measured drug clearance versus body mass, with a predicted clearance rate value of 30 ml/h in a 75 kg human. FIG. 18C shows measured volume of distribution versus body mass, with a predicted value of 5970 ml in a 75 kg human.

Conclusions:

It can be concluded from the results that addition of an XTEN to a glucose-regulating peptide, such as exendin-4, can greatly increase the terminal half-life compared to the peptide not linked to XTEN, and that a GPXTEN formulation with comparable half-life would permit considerably less frequent dosing than is currently employed with commercial products of glucose-regulating peptides, with dosing at weekly, every other week, or even monthly intervals possible.

TABLE 26

| Half-life of Ex4-XTEN | |
|---|---|
| Species | Half-Life (hr) |
| Mouse | 13.5 |
| Rat | 31.7 |
| Monkey | 60.7 |

TABLE 26-continued

| Half-life of Ex4-XTEN | |
|---|---|
| Species | Half-Life (hr) |
| Dog | 72.8 |
| Human | 140* |

*Predicted value based on allometric scaling

Example 29

Pharmacokinetics of Gcg-XTEN in Dogs

Beagle dogs (four per group) were injected subcutaneously with designated doses of synthetic glucagon (American Peptide, Sunnyvale, Calif.), Gcg-XTEN, or placebo. Animals were fasted for 12 hours preceding dosing and 6 hours following dosing. Blood glucose was tested at designated times before and after dosing using a hand-held glucometer (Walgreens TRUEresult™). Raw data was corrected for systematic bias between human and canine blood by comparison to reference samples across the entire linear range (40-250 mg/dL) measured in parallel at a diagnostic laboratory (Antech Diagnostics).

Figure 20:
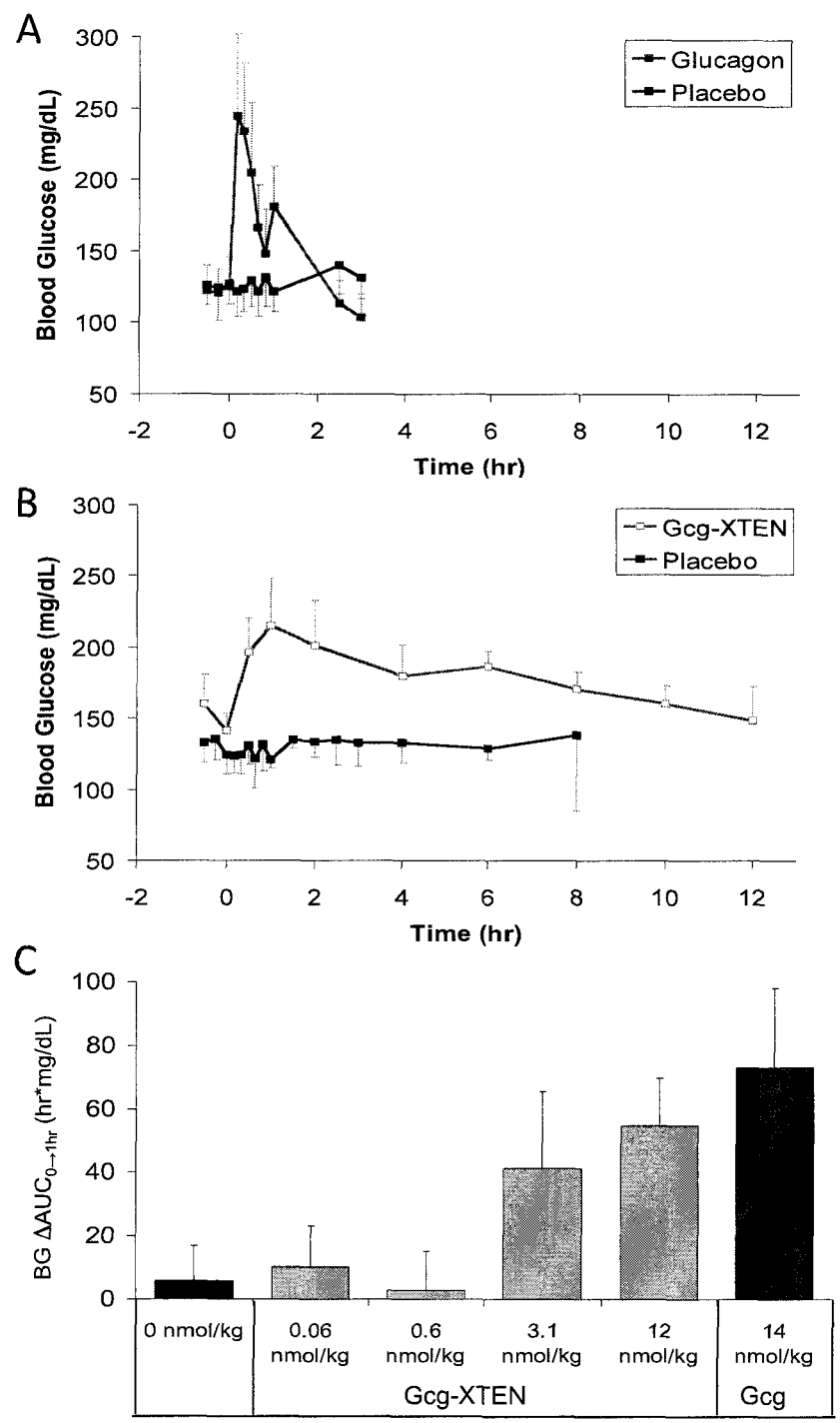
FIG. 20 shows results of a pharmacodynamic study in dogs dosed with glucagon or Gcg-XTEN (see Example 29 for experimental details). Glucagon (FIG. 20A) or Gcg-XTEN (FIG. 20B) was injected at 14 or 12 nmol/kg, respectively, into fasted beagle dogs (n=4 per group) and blood glucose levels were monitored in comparison to placebo injection, as shown in FIG. 20C. The difference in blood glucose area under the curve for the first hour after injection of placebo, Gcg-XTEN, or Glucagon (Gcg) relative to pre-injection baseline is shown (n=4-8 animals per group). The dose level for each group is indicated.

Blood glucose profiles following injection are shown in FIG. 20. The data show that Gcg-XTEN elevates blood glucose for an extended period of time relative to unmodified glucagon. Blood glucose levels after Gcg-XTEN administration return to baseline levels 10-12 hours after administration, consistent with the PK profile as previously determined in cynomolgus monkeys (data not shown).

Conclusions:

The addition of XTEN to the glucose regulating peptide glucagon markedly enhances the pharmacokinetic properties, including terminal half-life, compared to the native protein. In addition, the design of the glucagon containing GPXTEN of a select length results in a half-life that allows a return to baseline levels at an interval that makes it useful for the control of nocturnal hypoglycemia.

Example 30

Gcg-XTEN Confers Temporally-Controlled Resistance to Insulin-Induced Hypoglycemia in Dogs Beagle dogs (four per group, eight total) were subjected to a hypoglycemic challenge model in two phases, separated by a four-day washout period. In each phase, the animals were fed three hours prior to injection, then fasted for the remainder of the study. In each phase, groups were injected subcutaneously with 0.6 nmol/kg of Gcg-XTEN or placebo at time zero. In the first phase, hypoglycemic challenge was initiated 6 hours after test article injection by administration of 0.05 U/kg insulin (Novolin-R, Novo Nordisk Pharmaceuticals, Inc.). Hypoglycemic challenge in phase 2 was initiated identically, with the exception of being 12 hours following test article injection. Blood glucose levels were tested at designated times using a hand-held glucometer as above. Blood samples were taken pre-dose and one hour following insulin challenge in all animals. Samples were tested by clinical chemistry to confirm accuracy of the hand-held glucometer readings. In addition, clinical chemistry confirmed significantly elevated insulin levels following hypoglycemic challenge in all groups. Although slightly lower (~30%, data not shown) in Gcg-XTEN groups relative to placebo groups, the differences between groups were not statistically significant.

Figure 21:
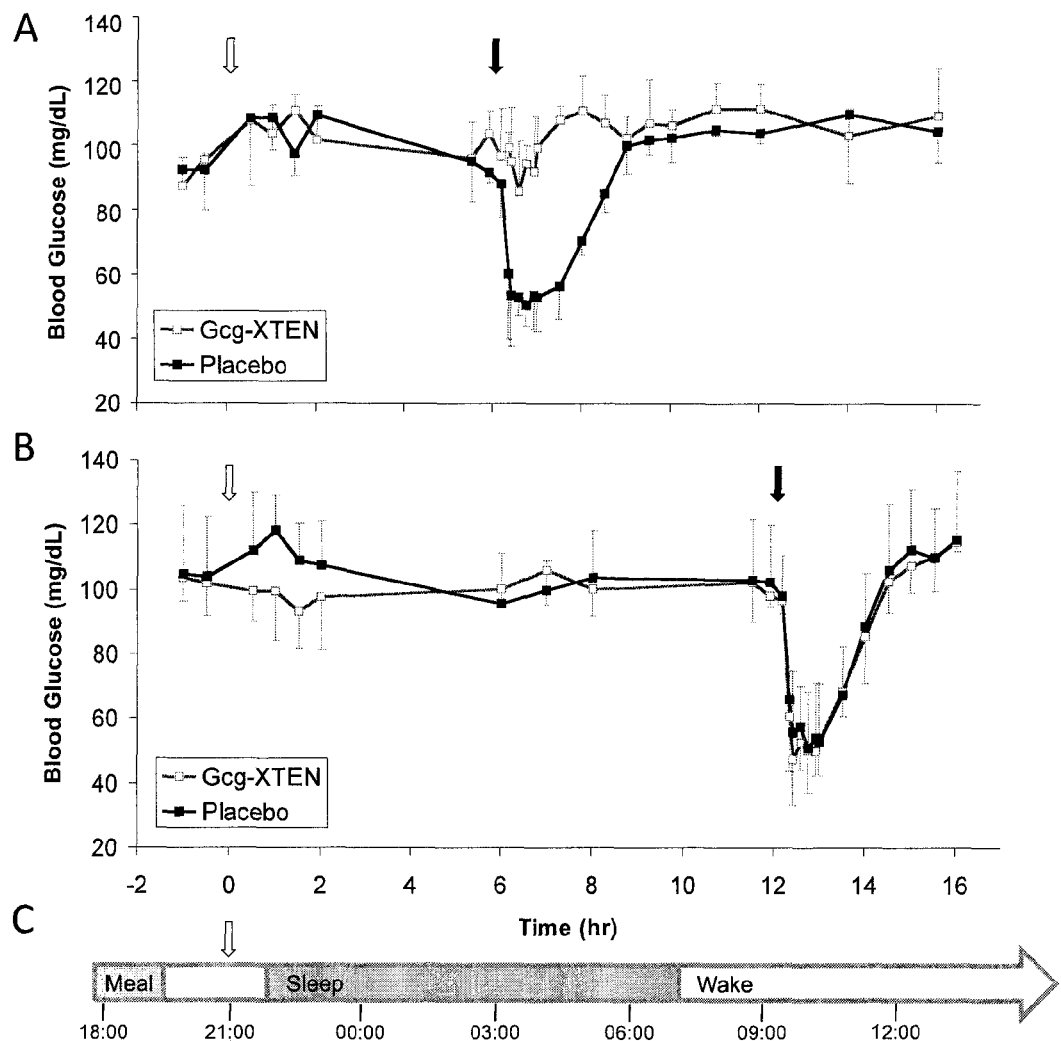
FIG. 21 shows results of a pharmacodynamic study in dogs dosed with glucagon or Gcg-XTEN and challenged with insulin in order to test whether Gcg-XTEN confers temporally-controlled resistance to insulin-induced hypoglycemia in dogs (see Example 30 for experimental details). Beagle dogs were fed three hours prior to the start of the experiment and fasted thereafter. At time=0, animals received either a dose of 0.6 nmol/kg Gcg-XTEN or placebo (open arrows). Animals (n=4 per group) received a challenge of 0.05 U/kg insulin to induce hypoglycemia at either 6 hr (FIG. 21A), indicated by solid arrow, or 12 hr (FIG. 21B) after initial dose, indicated by solid arrow.

The results of the sequential glucose determinations are shown in FIG. 21. The data show that animals receiving Gcg-XTEN were resistant to insulin-induced hypoglycemia at 6 hours after dosing (FIG. 21A), but not at 12 hours after dosing (FIG. 21B). Based on a hypothetical human timeline, assuming Gcg-XTEN dosing at 21:00, 6 hr post dose corresponds to 03:00 (during sleep) where protection of hypoglycemia is desired, and 12 hr post dose corresponds to 09:00 where the pharmacodynamic effect should have expired to allow for a morning meal.

Conclusions:

The addition of XTEN to the glucose regulating peptide glucagon and the particular design of the GPXTEN fusion protein as to length of XTEN results in a pharmacodynamic effect that 1) protects against insulin-induced hypoglycemia; and 2) is of a length of time that coincides with nocturnal hypoglycemia and then subsides at a time that would be consistent with a morning meal. This pharmacodynamic profile is well-suited for clinical applications in hypoglycemia in diabetic patients.

Example 31

Figure 22:
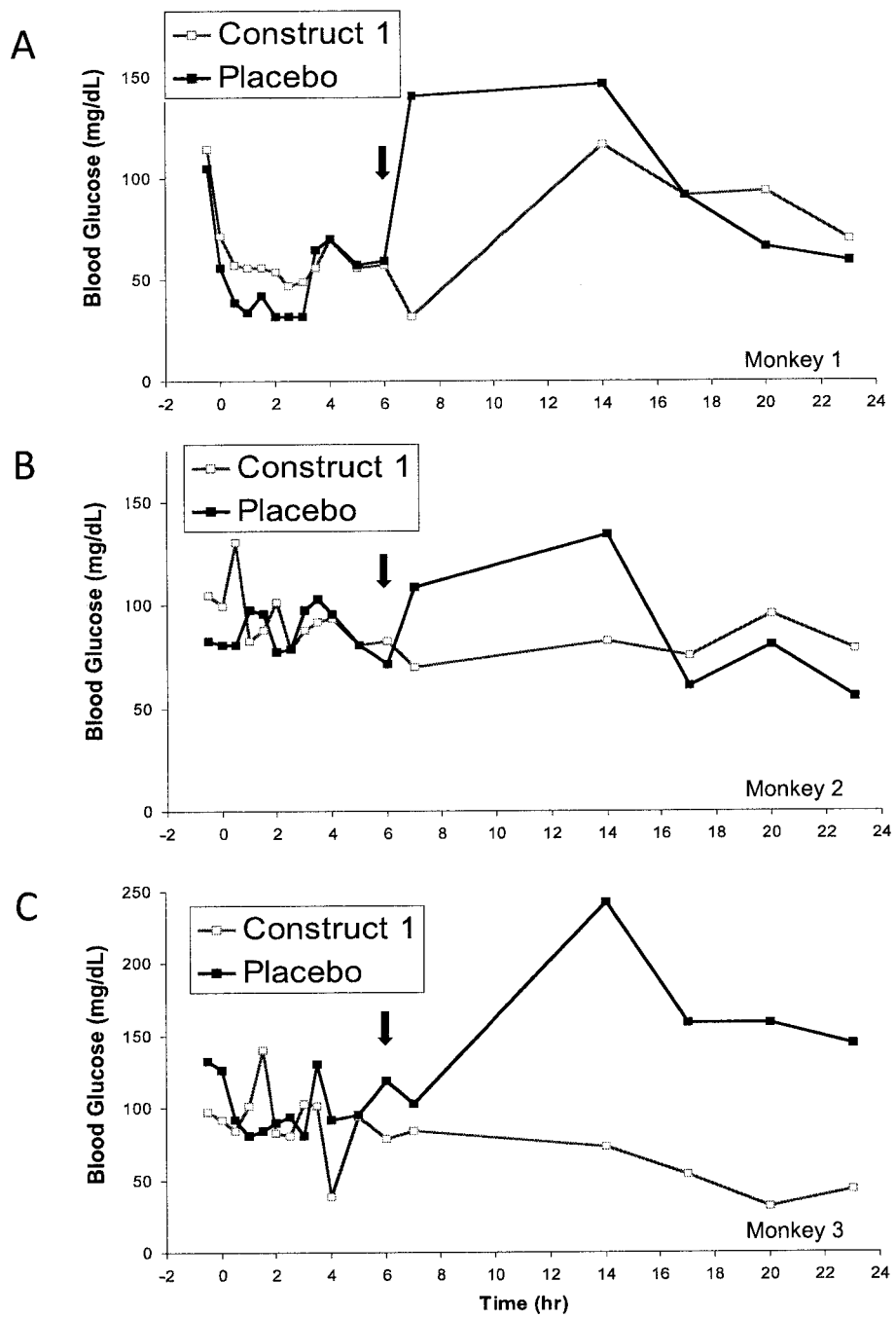
FIG. 22 shows results of a pharmacodynamic experiment dosed with glucagon or Gcg-XTEN_Y288 (Construct 1) to test the ability of the compounds to inhibit an increase in blood glucose after the end of fasting in cynomolgus monkeys (see Example 31 for experimental details).

Gcg-XTEN288 Inhibits Increase in Blood Glucose after End of Fasting in Cynomolgus Monkeys The effect of long-lived Gcg-XTEN_Y288 on appetite suppression was tested in normal cynomolgus monkeys. Animals were fasted for 12 hours prior to dosing and 6 hours following dosing. At time 0, animals received a randomized dose of either 7 nmol/kg of Gcg-XTEN_Y288 (Construct 1) or placebo. Blood glucose was measured by hand-held glucometer at designated times throughout the study. In a second phase, the same animals were treated with the alternate test article according to the same protocol. FIG. 22 shows overlaid plots of blood glucose profiles after placebo or Gcg-XTEN_Y288 administration for each individual animal. Solid arrows mark the time when food was returned to the animals (t=6 hours).

In each animal, when dosed with placebo, blood glucose is observed to spike upwards immediately after food is allowed following the 18 hr fasting period. This is consistent with the animals eating when food is allowed ad libitum. In comparison, when the same animals were dosed with Gcg-XTEN288 six hours prior to the return of food, no blood glucose spike is observed. This observation suggests that the appetite of these animals following the fasting period was suppressed by Gcg-XTEN288 administration.

Example 32

PK Analysis of Glucagon-XTEN Compositions in Cynomolgus Monkeys

Figure 28:
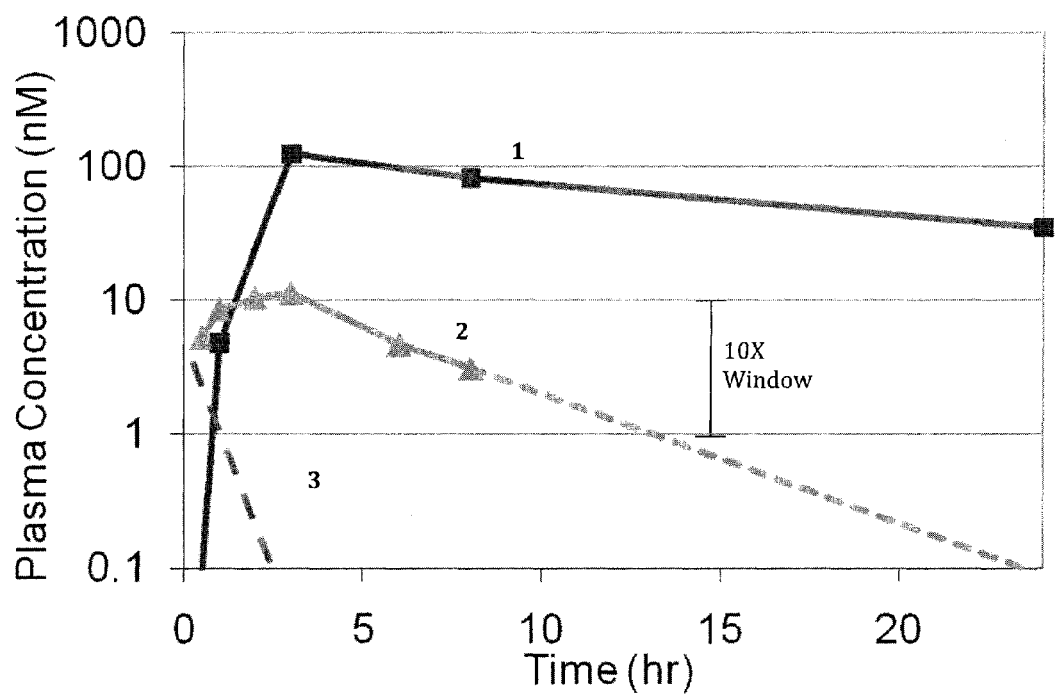
FIG. 28 shows the results of blood levels over time for glucagon-XTEN fusion proteins administered to cynomolgus monkeys, as described in Example 32. The GPXTEN administered were glucagon-Y288, glucagonY-144, and glucagon-Y72. The results from the glucagon-Y144 dosing shows <3-fold variation in blood levels over 0-6 hrs, with blood levels dropping below the 10× threshold from the $C_{max}$ at 10-12 hours.

GPXTEN compositions of glucagon linked to XTEN of varying length were evaluated to determine pharmacokinetic parameters in cynomolgus monkeys. Three different constructs with varying lengths of XTEN fused to glucagon were evaluated for the effects on PK parameters. The constructs glucagon-Y288, glucagonY-144 and glucagon-Y72 were administered to cynomolgus monkeys at a dose of 0.2 mg/kg subcutaneously. Serum samples were collected at various time points following administration and analyzed for serum concentrations of the construct using a sandwich ELISA format. Rabbit polyclonal anti-XTEN_Y antibodies were coated onto wells of an ELISA plate. Serum samples were then incubated in the wells at varying dilutions to allow capture of the compound by the coated antibodies. Wells were washed extensively, and bound protein was detected using a biotinylated preparation of the polyclonal anti-XTEN_Y antibody and streptavidin HRP. Serum protein concentrations were calculated at each time point by comparing the colorimetric response at each serum dilution to a standard curve. Pharmacokinetic parameters were calculated using the WinNonLin software package. FIG. 28 shows the results of blood levels over time for the glucagon-XTEN fusion proteins 1) glucagon-Y288; 2) glucagonY-144; and 3) glucagon-Y72. The results from the glucagon-Y144 dosing shows <3-fold variation in blood levels over 0-6 hrs, with blood levels dropping below the 10× threshold from the Cmax at 10-12 hours, indicating a favorable PK profile for maintaining the GPXTEN within a therapeutic window for conditions such as nocturnal hypoglycemia.

Conclusions:

The results indicate that the glucagons with longer XTEN lengths were detectable in the blood for extended periods in comparison to constructs with shorter lengths.

Example 33

Increasing Solubility and Stability of GP by Linking to XTEN

In order to evaluate the ability of XTEN to enhance the physical/chemical properties of solubility and stability, fusion proteins of glucagon plus shorter-length XTEN were prepared and evaluated. The test articles were prepared in Tris-buffered saline at neutral pH and characterization of the Gcg-XTEN solution was by reverse-phase HPLC and size exclusion chromatography to affirm that the protein was homogeneous and non-aggregated in solution. The data are presented in Table 27. For comparative purposes, the solubility limit of unmodified glucagon in the same buffer was measured at 60 μM (0.2 mg/mL), and the result demonstrate that for all lengths of XTEN added, a substantial increase in solubility was attained. Importantly, in most cases the glucagon-XTEN fusion proteins were prepared to achieve target concentrations and were not evaluated to determine the maximum solubility limits for the given construct. However, in the case of glucagon linked to the AF-144 XTEN, the limit of solubility was determined, with the result that a 60-fold increase in solubility was achieved, compared to glucagon not linked to XTEN. In addition, the glucagon-AF144 GPXTEN was evaluated for stability, and was found to be stable in liquid formulation for at least 6 months under refrigerated conditions and for approximately one month at 37° C. (data not shown).

Conclusions:

The data support the conclusion that the linking of short-length XTEN polypeptides to a biologically active protein such as glucagon can markedly enhance the solubility properties of the protein by the resulting fusion protein, as well as confer stability at the higher protein concentrations.

TABLE 27

Solubility of Glucagon-XTEN constructs

| Test Article | Solubility |
| --- | --- |
| Glucagon | 60 μM |
| Glucagon-Y36 | >370 μM |
| Glucagon-Y72 | >293 μM |

TABLE 27-continued

Solubility of Glucagon-XTEN constructs

| Test Article | Solubility |
|---|---|
| Glucagon-AF108 | >145 µM |
| Glucagon-AF120 | >160 µM |
| Glucagon-Y144 | >497 µM |
| Glucagon-AE144 | >467 µM |
| Glucagon-AF144 | >3600 µM |
| Glucagon-Y288 | >163 µM |

Example 34

Characterization of GPXTEN Secondary Structure

Figure 27:
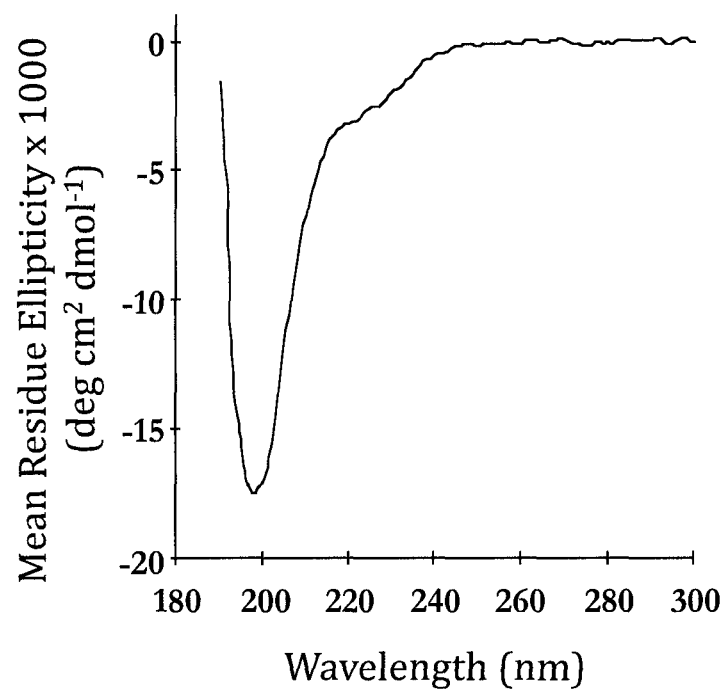
FIG. 27 shows the near UV circular dichroism spectrum of Ex4-XTEN_AE864, performed as described in Example 34.

The GPXTEN Ex4-AE864 was evaluated for degree of secondary structure by circular dichroism spectroscopy. CD spectroscopy was performed on a Jasco J-715 (Jasco Corporation, Tokyo, Japan) spectropolarimeter equipped with Jasco Peltier temperature controller (TPC-348WI). The concentration of protein was adjusted to 0.2 mg/mL in 20 mM sodium phosphate pH 7.0, 50 mM NaCl. The experiments were carried out using HELLMA quartz cells with an optical pathlength of 0.1 cm. The CD spectra were acquired at 5°, 25°, 45°, and 65° C. and processed using the J-700 version 1.08.01 (Build 1) Jasco software for Windows. The samples were equilibrated at each temperature for 5 min before performing CD measurements. All spectra were recorded in duplicate from 300 nm to 185 nm using a bandwidth of 1 nm and a time constant of 2 sec, at a scan speed of 100 nm/min. The CD spectrum shown in FIG. 27 shows no evidence of stable secondary structure and is consistent with an unstructured polypeptide.

Example 35

Biological Activity of Glucagon and Ex4 GPXTEN Constructs

Figure 29:
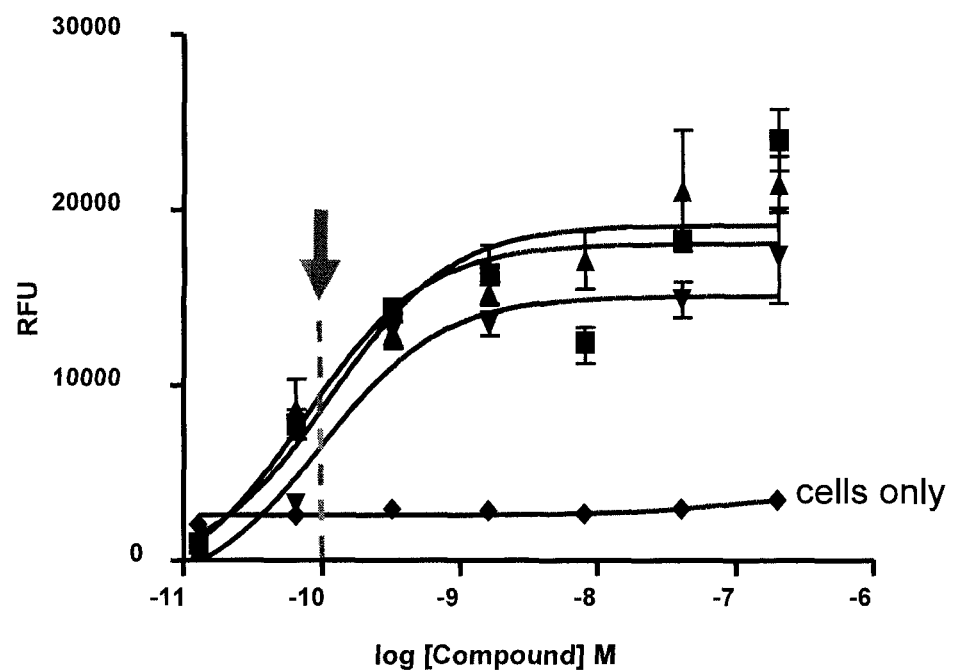
FIG. 29 shows the results of an in vitro cellular assay for GLP-1 activity, comparing exendin-4 from two commercial sources (closed triangles) to exendin-4 linked to Y288 (closed squares), with untreated cells (closed diamonds) used as a negative control (see Example 35 for experimental details). The EC50 is indicated by the dashed line.

Purified glucagon and exendin-3, each linked to Y288 as a GPXTEN fusion protein, were assayed for biological activity using an in vitro cell assay. Briefly, a ChemiScreen Stable Calcium Optimized glucagon receptor cell line was used for real-time calcium mobilization assays for glucagon and the glucagon-XTEN constructs, while an optimized exendin-4 receptor cell line expressing native GLP-1 receptor was used for exendin-4 and the Ex4 constructs. In this system, the cells express the native receptors and activation of this receptor results in calcium flux within the cell that can be detected using a FLIPR apparatus. As shown in FIG. 29, native glucagon results in an increase in signal in a dose-dependant manner. The EC50 for native glucagon in this system was found to be 4.1 nM. Titration of the glucagon-Y288 construct yielded a comparable response curve, with an EC50 of 72 nM. As shown in FIG. 29, native exendin-4 from two different commercial sources (Anaspec and Tocris) results in an increase in signal in a dose-dependant manner, with EC50s (indicated at dashed line) of 75 pM and 110 pM, respectively. Titration of the exendin-4-Y576 construct yielded a comparable response curve, with an EC50 of 98 pM, indicating that the fusion of the accessory protein retains full biological activity.

Conclusions:

The results indicate that the fusion of the glucose-regulating peptides exenidine-4 and glucagon to an XTEN results in compositions that retain biological activity.

Example 36

C-Terminal XTEN Releasable by Elastase-2

A GPXTEN fusion protein consisting of an XTEN protein fused to the C-terminus of a GP, such as exendin-4 (Ex4) can be created with a XTEN release site cleavage sequence placed in between the GP and XTEN components. Exemplary sequences are provided in Table 38. In this case, the release site contains an amino acid sequence that is recognized and cleaved by the elastase-2 protease (EC 3.4.21.37, Uniprot P08246). Specifically the sequence LGPV↓ISGVP (SEQ ID NO: 751) [Rawlings N. D., et al. (2008) Nucleic Acids Res., 36: D320], would be cut after position 4 in the sequence. Elastase is constitutively expressed by neutrophils and is present at all times in the circulation. Its activity is tightly controlled by serpins and is therefore minimally active most of the time. Therefore as the long-lived Ex4-XTEN circulates, a fraction of it would be cleaved, creating a pool of shorter-lived exendin-4 to be used in glucose homeostasis. In a desirable feature of the inventive composition, this creates a circulating pro-drug depot that constantly releases an amount of free, fully active exendin-4.

Example 37

C-Terminal XTEN Releasable by MMP-12

An amylin-XTEN fusion protein consisting of an XTEN protein fused to the C-terminus of amylin can be created with a XTEN release site cleavage sequence placed in between the amylin and XTEN components. Exemplary sequences are provided in Table 38. In this case, the GPXTEN release site contains an amino acid sequence that is recognized and cleaved by the MMP-12 protease (EC 3.4.24.65, Uniprot P39900). Specifically the sequence GPAGILGGA (SEQ ID NO: 752) [Rawlings N. D., et al. (2008) Nucleic Acids Res., 36: D320] would be cut after position 4 of the sequence. MMP-12 is constitutively expressed in whole blood. Therefore as the long-lived amylin-XTEN circulates, a fraction of it would be cleaved, creating a pool of shorter-lived amylin to be used in glucose homeostasis. In a desirable feature of the inventive composition, this creates a circulating pro-drug depot that constantly releases an amount of free, fully active amylin.

Example 38

Human Clinical Trial Designs for Evaluating GPXTEN

Clinical trials can be designed such that the efficacy and advantages of the GPXTEN compositions, relative to single biologics, can be verified in humans. For example, the GPXTEN fusion constructs comprising both glucagon and exenatide, as described in the Examples above, are used in clinical trials for characterizing the efficacy of the compositions. The trials are conducted in one or more metabolic diseases, disorders, or conditions that is improved, ameliorated, or inhibited by the administration of glucagon and exenatide. Such studies in adult patients comprise three phases. First, a Phase I safety and pharmacokinetics study in adult patients is conducted to determine the maximum tolerated dose and pharmacokinetics and pharmacodynamics in humans (either normal subjects or patients with a metabolic disease or condition), as well as to define potential toxicities and adverse events to be tracked in future studies. The study is conducted in which single rising doses of compositions of fusion proteins of XTEN linked to glucagon and exenatide is administered and biochemical, PK, and clinical parameters are measured. This permits the determination of the maximum tolerated dose and establishes the threshold and maximum concentrations in dosage and circulating drug that constitute the therapeutic window for the respective components. Thereafter, clinical trials would be conducted in patients with the disease, disorder or condition.

Clinical Trial in Diabetes

A phase II dosing study is conducted in diabetic patients where serum glucose pharmacodynamics and other physiologic, PK, safety and clinical parameters (such as listed below) appropriate for diabetes, insulin resistance and obesity conditions are measured as a function of the dosing of the fusion proteins comprising XTEN linked to glucagon and exenatide, yielding dose-ranging information on doses appropriate for a Phase III trial, in addition to collecting safety data related to adverse events. The PK parameters are correlated to the physiologic, clinical and safety parameter data to establish the therapeutic window for each component of the GPXTEN composition, permitting the clinician to establish either the appropriate ratio of the two component fusion proteins each comprising one glucose regulating peptide, or to determine the single dose for a monomeric GPXTEN comprising two glucose regulating peptides. Finally, a phase III efficacy study is conducted wherein diabetic patients would be administered either the GPXTEN composition, a positive control, or a placebo daily, bi-weekly, or weekly (or other dosing schedule deemed appropriate given the pharmacokinetic and pharmacodynamic properties of the GPXTEN composition) for an extended period of time. Primary outcome measures of efficacy could include HbA1c concentrations, while secondary outcome measures include insulin requirement during the study, stimulated C peptide and insulin concentrations, fasting plasma glucose (FPG), serum cytokine levels, CRP levels, and insulin secretion and Insulin-sensitivity index derived from an OGTT with insulin and glucose measurements, as well as body weight, food consumption, and other accepted diabetic markers that are tracked relative to the placebo or positive control group. Efficacy outcomes are determined using standard statistical methods. Toxicity and adverse event markers also are followed in this study to verify that the compound is safe when used in the manner described.

Example 39

Analysis of Sequences for Secondary Structure by Prediction Algorithms

Amino acid sequences is assessed for secondary structure via certain computer programs or algorithms, such as the well-known Chou-Fasman algorithm (Chou, P. Y., et al. (1974) *Biochemistry*, 13: 222-45) and the Garnier-Osguthorpe-Robson, or "GOR" method (Garnier J, Gibrat J F, Robson B. (1996). GOR method for predicting protein secondary structure from amino acid sequence. Methods Enzymol 266:540-553). For a given sequence, the algorithms can predict whether there exists some or no secondary structure at all, expressed as total and/or percentage of residues of the sequence that form, for example, alpha-helices or beta-sheets or the percentage of residues of the sequence predicted to result in random coil formation.

Several representative sequences from XTEN "families" have been assessed using two algorithm tools for the Chou-Fasman and GOR methods to assess the degree of secondary structure in these sequences. The Chou-Fasman tool was provided by William R. Pearson and the University of Virginia, at the "Biosupport" internet site, URL located on the World Wide Web at fasta.bioch.virginia.edu/fasta_www2/fasta_www.cgi?rm=misc1 as it existed on Jun. 19, 2009. The GOR tool was provided by Pole Informatique Lyonnais at the Network Protein Sequence Analysis internet site, URL located on the World Wide Web at .npsa-pbil.ibcp.fr/cgi-bin/secpred_gor4.pl as it existed on Jun. 19, 2008.

As a first step in the analyses, a single XTEN sequence was analyzed by the two algorithms. The AE864 composition is a XTEN with 864 amino acid residues created from multiple copies of four 12 amino acid sequence motifs consisting of the amino acids G, S, T, E, P, and A. The sequence motifs are characterized by the fact that there is limited repetitiveness within the motifs and within the overall sequence in that the sequence of any two consecutive amino acids is not repeated more than twice in any one 12 amino acid motif, and that no three contiguous amino acids of full-length the XTEN are identical. Successively longer portions of the AF 864 sequence from the N-terminus were analyzed by the Chou-Fasman and GOR algorithms (the latter requires a minimum length of 17 amino acids). The sequences were analyzed by entering the FASTA format sequences into the prediction tools and running the analysis. The results from the analyses are presented in Table 28.

The results indicate that, by the Chou-Fasman calculations, the four motifs of the AE family (Table 4) have no alpha-helices or beta sheets. The sequence up to 288 residues was similarly found to have no alpha-helices or beta sheets. The 432 residue sequence is predicted to have a small amount of secondary structure, with only 2 amino acids contributing to an alpha-helix for an overall percentage of 0.5%. The full-length AF864 polypeptide has the same two amino acids contributing to an alpha-helix, for an overall percentage of 0.2%. Calculations for random coil formation revealed that with increasing length, the percentage of random coil formation increased. The first 24 amino acids of the sequence had 91% random coil formation, which increased with increasing length up to the 99.77% value for the full-length sequence.

Numerous XTEN sequences of 500 amino acids or longer from the other motif families were also analyzed and revealed that the majority had greater than 95% random coil formation. The exceptions were those sequences with one or more instances of three contiguous serine residues, which resulted in predicted beta-sheet formation. However, even these sequences still had approximately 99% random coil formation.

In contrast, a polypeptide sequence of 84 residues limited to A, S, and P amino acids was assessed by the Chou-Fasman algorithm, which predicted a high degree of predicted alpha-helices. The sequence, which had multiple repeat "AA" and "AAA" sequences, had an overall predicted percentage of alpha-helix structure of 69%. The GOR algorithm predicted 78.57% random coil formation; far less than any sequence consisting of 12 amino acid sequence motifs consisting of the amino acids G, S, T, E, P, analyzed in the present Example.

Conclusions:

The analysis supports the conclusion that: 1) XTEN created from multiple sequence motifs of G, S, T, E, P, and A that have limited repetitiveness as to contiguous amino acids are predicted to have very low amounts of alpha-helices and beta-sheets; 2) that increasing the length of the XTEN does not appreciably increase the probability of alpha-helix or beta-sheet formation; and 3) that progressively increasing the length of the XTEN sequence by addition of non-repetitive 12-mers consisting of the amino acids G, S, T, E, P, and A results in increased percentage of random coil formation. In contrast, polypeptides created from amino acids limited to A, S and P that have a higher degree of internal repetitiveness are predicted to have a high percentage of alpha-helices, as determined by the Chou-Fasman algorithm, as well as random coil formation. Based on the numerous sequences evaluated by these methods, it is concluded that XTEN created from sequence motifs of G, S, T, E, P, and A that have limited repetitiveness (defined as no more than two identical contiguous amino acids in any one motif) greater than about 400 amino acid residues in length are expected to have very limited secondary structure. With the exception of motifs containing three contiguous serines, it is believed that any order or combination of sequence motifs from Table 4 can be used to create an XTEN polypeptide of a length greater than about 400 residues that will result in an XTEN sequence that is substantially devoid of secondary structure. Such sequences are expected to have the characteristics described in the GPX-TEN embodiments of the invention disclosed herein.

TABLE 28

CHOU-FASMAN and GOR prediction calculations of secondary structure

| SEQ NAME | Sequence | SEQ ID NO: | No. Residues | Chou-Fasman Calculation | GOR Calculation |
|---|---|---|---|---|---|
| | GSTSESPSGTAP | 753 | 12 | Residue totals*: H: 0 E: 0 percent: H: 0.0 E: 0.0 | Not Determined |
| | GTSTPESGSASP | 754 | 12 | Residue totals: H: 0 E: 0 percent: H: 0.0 E: 0.0 | Not Determined |
| | GTSPSGESSTAP | 755 | 12 | Residue totals: H: 0 E: 0 percent: H: 0.0 E: 0.0 | Not Determined |
| | GSTSSTAESPGP | 756 | 12 | Residue totals: H: 0 E: 0 percent: H: 0.0 E: 0.0 | Not Determined |
| | GSPAGSPTSTEEGTSESATPESGP | 757 | 24 | Residue totals: H: 0 E: 0 percent: H: 0.0 E: 0.0 | 91.67% |
| | GSPAGSPTSTEEGTSESATPESGPGTSTEPSEGSAP | 758 | 36 | Residue totals: H: 0 E: 0 percent: H: 0.0 E: 0.0 | 94.44% |
| | GSPAGSPTSTEEGTSESATPESGPGTSTEPSEGSAPGSPAGSPTSTEE | 759 | 48 | Residue totals: H: 0 E: 0 percent: H: 0.0 E: 0.0 | 93.75% |
| | SPAGSPTSTEEGTSESATPESGPGTSTEPSEGSAPGSPAGSPTSTEEGTSTEPSEGSAP | 760 | 60 | Residue totals: H: 0 E: 0 percent: H: 0.0 E: 0.0 | 96.67% |
| | GSPAGSPTSTEEGTSESATPESGPGTSTEPSEGSAPGSPAGSPTSTEEGTSTEPSEGSAPGTSESATPESGPGSEPATSGSETPGSEPATSGSETP | 761 | 108 | Residue totals: H: 0 E: 0 percent: H: 0.0 E: 0.0 | 97.22% |
| | GSPAGSPTSTEEGTSESATPESGPGTSTEPSEGSAPGSPAGSPTSTEEGTSTEPSEGSAPGTSESATPESGPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAP | 762 | 216 | Residue totals: H: 0 E: 0 percent: H: 0.0 E: 0.0 | 99.07% |
| | GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPES | 763 | 432 | Residue totals: H: 2 E: 3 percent: H: 0.5 E: 0.7 | 99.54% |

TABLE 28-continued

CHOU-FASMAN and GOR prediction calculations of secondary structure

| SEQ NAME | Sequence | SEQ ID NO: | No. Residues | Chou-Fasman Calculation | GOR Calculation |
|---|---|---|---|---|---|
|  | GPGSEPATSGSETPGTSESATPESGPGTSTE PSEGSAPGTSTEPSEGSAPGTSTEPSEGSAP GTSTEPSEGSAPGTSTEPSEGSAPGTSTEPS EGSAPGSPAGSPTSTEEGTSTEPSEGSAP |  |  |  |  |
| AE864 | GSPAGSPTSTEEGTSESATPESGPGTSTEPS EGSAPGSPAGSPTSTEEGTSTEPSEGSAPGT STEPSEGSAPGTSESATPESGPGSEPATSGS ETPGSEPATSGSETPGSPAGSPTSTEEGTSE SATPESGPGTSTEPSEGSAPGTSTEPSEGSA PGSPAGSPTSTEEGTSTEPSEGSAPGTSTEP SEGSAPGTSESATPESGPGTSTEPSEGSAPG TSESATPESGPGSEPATSGSETPGTSTEPSE GSAPGTSTEPSEGSAPGTSESATPESGPGTS ESATPESGPGSPAGSPTSTEEGTSESATPES GPGSEPATSGSETPGTSESATPESGPGTSTE PSEGSAPGTSTEPSEGSAPGTSTEPSEGSAP GTSTEPSEGSAPGTSTEPSEGSAPGTSTEPS EGSAPGSPAGSPTSTEEGTSTEPSEGSAPGT SESATPESGPGSEPATSGSETPGTSESATPE SGPGSEPATSGSETPGTSESATPESGPGTST EPSEGSAPGTSESATPESGPGSPAGSPTSTE EGSPAGSPTSTEEGSPAGSPTSTEEGTSESA TPESGPGTSTEPSEGSAPGTSESATPESGPG SEPATSGSETPGTSESATPESGPGSEPATSG SETPGTSESATPESGPGTSTEPSEGSAPGSP AGSPTSTEEGTSESATPESGPGSEPATSGSE TPGTSESATPESGPGSPAGSPTSTEEGSPAG SPTSTEEGTSTEPSEGSAPGTSESATPESGP GTSESATPESGPGTSESATPESGPGSEPATS GSETPGSEPATSGSETPGSPAGSPTSTEEGT STEPSEGSAPGTSTEPSEGSAPGSEPATSGS ETPGTSESATPESGPGTSTEPSEGSAP | 764 | 864 | Residue totals: H: 2 E: 3 percent: H: 0.2 E: 0.3 | 99.77% |
| AD 576 | GSSESGSSEGGPGSSGEPSESGSSGSSESGS SEGGPGSSESGSSEGGPGSSESGSSEGGPGS SESGSSEGGPGSSESGSSEGGPGESPGGSSG SESGSEGSSGPGESSGSSESGSSEGGPGSSE SGSSEGGPGSSESGSSEGGPGSSGGEPSESGS SGESPGGSSGSESGESPGGSSGSESGSGGEP SESGSSGSSESGSSEGGPGSGGGEPSESGSSG SGGEPSESGSSGSEGSSGPGESSGESPGGSS GSESGSGGEPSESGSSGSGGEPSESGSSGSG GEPSESGSSGSSESGSSEGGPGESPGGSSGS ESGESPGGSSGSESGESPGGSSGSESGESPG GSSGSESGESPGGSSGSESGSSESGSSEGGP GSSGGEPSESGSSGSEGSSGPGESSGSSESGS SEGGPGSSGGEPSESGSSGSSESGSSEGGPGS GGEPSESGSSGESPGGSSGSESGESPGGSSG SESGSSESGSSEGGPGSSGGEPSESGSSGSSE SGSSEGGPGSGGEPSESGSSGSGGEPSESGS SGESPGGSSGSESGSEGSSGPGESSGSSESG SSEGGPGSEGSSGPGESS | 765 | 576 | Residue totals: H: 7 E: 0 percent: H: 1.2 E: 0.0 | 99.65% |
| AE576 | GSPAGSPTSTEEGTSESATPESGPGTSTEPS EGSAPGSPAGSPTSTEEGTSTEPSEGSAPGT STEPSEGSAPGTSESATPESGPGSEPATSGS ETPGSEPATSGSETPGSPAGSPTSTEEGTSE SATPESGPGTSTEPSEGSAPGTSTEPSEGSA PGSPAGSPTSTEEGTSTEPSEGSAPGTSTEP SEGSAPGTSESATPESGPGTSTEPSEGSAPG TSESATPESGPGSEPATSGSETPGTSTEPSE GSAPGTSTEPSEGSAPGTSESATPESGPGTS ESATPESGPGSPAGSPTSTEEGTSESATPES GPGSEPATSGSETPGTSESATPESGPGTSTE PSEGSAPGTSTEPSEGSAPGTSTEPSEGSAP GTSTEPSEGSAPGTSTEPSEGSAPGTSTEPS EGSAPGSPAGSPTSTEEGTSTEPSEGSAPGT SESATPESGPGSEPATSGSETPGTSESATPE SGPGSEPATSGSETPGTSESATPESGPGTST EPSEGSAPGTSESATPESGPGSPAGSPTSTE EGSPAGSPTSTEEGSPAGSPTSTE7EGTSES ATPESGPGTSTEPSEGSAP | 766 | 576 | Residue totals: H: 2 E: 0 percent: H: 0.4 E: 0.0 | 99.65% |

TABLE 28-continued

CHOU-FASMAN and GOR prediction calculations of secondary structure

| SEQ NAME | Sequence | SEQ ID NO: | No. Residues | Chou-Fasman Calculation | GOR Calculation |
|---|---|---|---|---|---|
| AF540 | GSTSSTAESPGPGSTSSTAESPGPGSTSESP SGTAPGSTSSTAESPGPGSTSSTAESPGPGT STPESGSASPGSTSESPSGTAPGTSPSGESS TAPGSTSESPSGTAPGSTSESPSGTAPGTSP SGESSTAPGSTSESPSGTAPGSTSESPSGTA PGTSPSGESSTAPGSTSESPSGTAPGSTSES PSGTAPGSTSESPSGTAPGTSTPESGSASPG STSESPSGTAPGTSTPESGSASPGSTSSTAE SPGPGSTSSTAESPGPGTSTPESGSASPGTS TPESGSASPGSTSESPSGTAPGTSTPESGSA SPGTSTPESGSASPGSTSESPSGTAPGSTSE SPSGTAPGSTSESPSGTAPGSTSSTAESPGP GTSTPESGSASPGTSTPESGSASPGSTSESP SGTAPGSTSESPSGTAPGTSTPESGSASPGS TSESPSGTAPGSTSESPSGTAPGTSTPESGS ASPGTSPSGESSTAPGSTSSTAESPGPGTSP SGESSTAPGSTSSTAESPGPGTSTPESGSAS PGSTSESPSGTAP | 767 | 540 | Residue totals: H: 2 E: 0 percent: H: 0.4 E: 0.0 | 99.65 |
| AF504 | GASPGTSSTGSPGSSPSASTGTGPGSSPSAS TGTGPGTPGSGTASSSPGSSTPSGATGSPGS NPSASTGTGPGASPGTSSTGSPGTPGSGTAS SSPGSSTPSGATGSPGTPGSGTASSSPGASP GTSSTGSPGASPGTSSTGSPGTPGSGTASSS PGSSTPSGATGSPGASPGTSSTGSPGTPGSG TASSSPGSSTPSGATGSPGSNPSASTGTGPG SSPSASTGTGPGSSTPSGATGSPGSSTPSGA TGSPGASPGTSSTGSPGASPGTSSTGSPGAS PGTSSTGSPGTPGSGTASSSPGASPGTSSTG SPGASPGTSSTGSPGASPGTSSTGSPGSSPS ASTGTGPGTPGSGTASSSPGASPGTSSTGSP GASPGTSSTGSPGASPGTSSTGSPGSSTPSG ATGSPGSSTPSGATGSPGASPGTSSTGSPGT PGSGTASSSPGSSTPSGATGSPGSSTPSGAT GSPGSSTPSGATGSPGSSPSASTGTGPGASP GTSSTGSP | 768 | 504 | Residue totals: H: 0 E: 0 percent: H: 0.0 E: 0.0 | 94.44% |
| AE864 | GSPAGSPTSTEEGTSESATPESGPGTSTEPS EGSAPGSPAGSPTSTEEGTSTEPSEGSAPGT STEPSEGSAPGTSESATPESGPGSEPATSGS ETPGSEPATSGSETPGSPAGSPTSTEEGTSE SATPESGPGTSTEPSEGSAPGTSTEPSEGSA PGSPAGSPTSTEEGTSTEPSEGSAPGTSTEP SEGSAPGTSESATPESGPGTSTEPSEGSAPG TSESATPESGPGSEPATSGSETPGTSTEPSE GSAPGTSTEPSEGSAPGTSESATPESGPGTS ESATPESGPGSPAGSPTSTEEGTSESATPES GPGSEPATSGSETPGTSESATPESGPGTSTE PSEGSAPGTSTEPSEGSAPGTSTEPSEGSAP GTSTEPSEGSAPGTSTEPSEGSAPGTSTEPS EGSAPGSPAGSPTSTEEGTSTEPSEGSAPGT SESATPESGPGSEPATSGSETPGTSESATPE SGPGSEPATSGSETPGTSESATPESGPGTST EPSEGSAPGTSESATPESGPGSPAGSPTSTE EGSPAGSPTSTEEGSPAGSPTSTEEGTSESA TPESGPGTSTEPSEGSAPGTSESATPESGPG SEPATSGSETPGTSESATPESGPGSEPATSG SETPGTSESATPESGPGTSTEPSEGSAPGSP AGSPTSTEEGTSESATPESGPGSEPATSGSE TPGTSESATPESGPGSPAGSPTSTEEGSPAG SPTSTEEGTSTEPSEGSAPGTSESATPESGP GTSESATPESGPGTSESATPESGPGSEPATS GSETPGSEPATSGSETPGSPAGSPTSTEEGT STEPSEGSAPGTSTEPSEGSAPGSEPATSGS ETPGTSESATPESGPGTSTEPSEGSAP | 769 | 864 | Residue totals: H: 2 E: 3 percent: H: 0.2 E: 0.4 | 99.77% |
| AF864 | GSTSESPSGTAPGTSPSGESSTAPGSTSESP SGTAPGSTSESPSGTAPGTSTPESGSASPGT STPESGSASPGSTSESPSGTAPGSTSESPSG TAPGTSPSGESSTAPGSTSESPSGTAPGTSP SGESSTAPGSTSPSGESSTAPGSTSSTAESPG PGTSPSGESSTAPGTSPSGESSTAPGSTSST AESPGPGTSTPESGSASPGTSTPESGSASPG STSESPSGTAPGTSESPSGTAPGTSTPESG SASPGSTSSTAESPGPGTSTPESGSASPGST | 770 | 875 | Residue totals: H: 2 E: 0 percent: H: 0.2 E: 0.0 | 95.20% |

TABLE 28-continued

CHOU-FASMAN and GOR prediction calculations of secondary structure

| SEQ NAME | Sequence | SEQ ID NO: | No. Residues | Chou-Fasman Calculation | GOR Calculation |
|---|---|---|---|---|---|
| | SESPSGTAPGTSPSGESSTAPGSTSSTAESP GPGTSPSGESSTAPGTSTPESGSASPGSTSS TAESPGPGSTSSTAESPGPGSTSSTAESPGP GSTSSTAESPGPGTSPSGESSTAPGSTSESP SGTAPGSTSESPSGTAPGTSTPESGPXXXGA SASGAPSTXXXXSESPSGTAPGSTSESPSGT APGSTSESPSGTAPGSTSESPSGTAPGSTSE SPSGTAPGSTSESPSGTAPGTSTPESGSASP GTSPSGESSTAPGTSPSGESSTAPGSTSSTA ESPGPGTSPSGESSTAPGTSTPESGSASPGS TSESPSGTAPGSTSESPSGTAPGTSPSGESS TAPGSTSESPSGTAPGTSTPESGSASPGTST PESGSASPGSTSESPSGTAPGTSTPESGSAS PGSTSSTAESPGPGSTSESPSGTAPGSTSES PSGTAPGTSPSGESSTAPGTSSTAESPGPG TSPSGESSTAPGTSTPESGSASPGTSPSGES STAPGTSPSGESSTAPGTSPSGESSTAPGST SSTAESPGPGSTSSTAESPGPGTSPSGESST APGSSPSASTGTGPGSSTPSGATGSPGSSTP SGATGSP | | | | |
| AG864 | GGSPGASPGTSSTGSPGSSPSASTGTGPGSS PSASTGTGPGSTPGSGTASSSPGSSTPSGATG SPGSNPSASTGTGPGASPGTSSTGSPGTPGS GTASSSPGSSTPSGATGSPGTPGSGTASSSP GASPGTSSTGSPGASPGTSSTGSPGTPGSGT ASSSPGSSTPSGATGSPGASPGTSSTGSPGT PGSGTASSSPGSSTPSGATGSPGSNPSASTG TGPGSSPSASTGT7GPGSSTPSGATGSPGSS TPSGATGSPGASPGTSSTGSPGASPGTSSTG SPGASPGTSSTGSPGTPGSGTASSSPGASPG TSSTGSPGASPGTSSTGSPGASPGTSSTGSP GSSPSASTGTGPGTPGSGTASSSPGASPGTS STGSPGASPGTSSTGSPGASPGTSSTGSPGS STPSGATGSPGSSTPSGATGSPGASPGTSST GSPGTPGSGTASSSPGSSTPSGATGSPGSST PSGATGSPGSSTPSGATGSPGSSPSASTGTG PGASPGTSSTGSPGASPGTSSTGSPGTPGSG TASSSPGASPGTSSTGSPGASPGTSSTGSPG ASPGTSSTGSPGASPGTSSTGSPGTPGSGTA SSSPGSSTPSGATGSPGTPGSGTASSSPGSS TPSGATGSPGTPGSGTASSSPGSSTPSGATG SPGSSTPSGATGSPGSSPSASTGTGPGSSPS ASTGTGPGASPGTSSTGSPGTPGSGTASSSP GSSTPSGATGSPGSSPSASTGTGPGSSPSAS TGTGPGASPGTSSTGSPGASPGTSSTGSPGS STPSGATGSPGSSPSASTGTGPGASPGTSST GSPGSSPSASTGTGPGTPGSGTASSSPGSST PSGATGSPGSSTPSGATGSPGASPGTSSTGS P | 771 | 868 | Residue totals: H: 0 E: 0 percent: H: 0.0 E: 0.0 | 94.70% |
| AM875 | GTSTEPSEGSAPGSEPATSGSETPGSPAGSP TSTEEGSTSSTAESPGPGTSTPESGSASPGS TSESPSGTAPGSTSESPSGTAPGTSTPESGS ASPGTSTPESGSASPGSEPATSGSETPGTSE SATPESGPGSPAGSPTSTEEGTSTEPSEGSA PGTSESATPESGPGTSTEPSEGSAPGTSTEP SEGSAPGSPAGSPTSTEEGTSTEPSEGSAPG TSTEPSEGSAPGTSESATPESGPGTSESATP ESGPGTSTEPSEGSAPGTSTEPSEGSAPGTS ESATPESGPGTSTEPSEGSAPGSEPATSGSE TPGSPAGSPTSTEEGSSTPSGATGSPGTPGS GTASSSPGSSTPSGATGSPGTSTEPSEGSAP GTSTEPSEGSAPGSEPATSGSETPGSPAGSP TSTEEGSPAGSPTSTEEGTSTEPSEGSAPGA SASGAPSTGGTSESATPESGPGSPAGSPTST EEGSPAGSPTSTEEGSTSSTAESPGPGSTSE SPSGTAPGTSPSGESSTAPGTPGSGTASSSP GSSTPSGATGSPGSSPSASTGTGPGSEPATS GSETPGTSESATPESGPGSEPATSGSETPGS TSSTAESPGPGSTSSTAESPGPGTSPSGESS TAPGSEPATSGSETPGSEPATSGSETPGTST EPSEGSAPGSSSTAESPGPGTSTPESGSAS PGSTSESPSGTAPGTSTEPSEGSAPGTSTEP SEGSAPGTSTEPSEGSAPGSSTPSGATGSPG | 772 | 875 | Residue totals: H: 7 E: 3 percent: H: 0.8 E: 0.3 | 98.63% |

TABLE 28-continued

CHOU-FASMAN and GOR prediction calculations of secondary structure

| SEQ NAME | Sequence | SEQ ID NO: | No. Residues | Chou-Fasman Calculation | GOR Calculation |
|---|---|---|---|---|---|
| | SSPSASTGTGPGASPGTSSTGSPGSEPATSG SETPGTSESATPESGPGSPAGSPTSTEEGSS TPSGATGSPGSSPSASTGTGPGASPGTSSTG SPGTSESATPESGPGTSTEPSEGSAPGTSTE PSEGSAP | | | | |
| AM1318 | GTSTEPSEGSAPGSEPATSGSETPGSPAGSP TSTEEGSTSSTAESPGPGTSTPESGSASPGS TSESPSGTAPGSTSESPSGTAPGTSTPESGS ASPGTSTPESGSASPGSEPATSGSETPGTSE SATPESGPGSPAGSPTSTEEGTSTEPSEGSA PGTSESATPESGPGTSTEPSEGSAPGTSTEP SEGSAPGSPAGSPTSTEEGTSTEPSEGSAPG TSTEPSEGSAPGTSESATPESGPGTSESATP ESGPGTSTEPSEGSAPGTSTEPSEGSAPGTS ESATPESGPGTSTEPSEGSAPGSEPATSGSE TPGSPAGSPTSTEEGSSTPSGATGSPGTPGS GTASSSPGSSTPSGATGSPGTSTEPSEGSAP GTSTEPSEGSAPGSEPATSGSETPGSPAGSP TSTEEGSPAGSPTSTEEGTSTEPSEGSAPGP EPTGPAPSGGSEPATSGSETPGTSESATPES GPGSRAGSPTSTEEGTSESATPESGPGSPAG SPTSTEEGSPAGSPTSTEEGTSESATPESGP GSPAGSPTSTEEGSPAGSPTSTEEGSTSSTA ESPGPGSTSESPSGTAPGTSPSGESSTAPGS TSESPSGTAPGSTSESPSGTAPGTSPSGESS TAPGTSTEPSEGSAPGTSESATPESGPGTSE SATPESGPGSEPATSGSETPGTSESATPESG PGTSESATPESGPGTSTEPSEGSAPGTSESA TPESGPGTSTEPSEGSAPGTSPSGESSTAPG TSPSGESSTAPGTSPSGESSTAPGTSTEPSE GSAPGSRAGSPTSTEEGTSTEPSEGSAPGSS PSASTGTGPGSSTPSGATGSPGSSTPSGATG SPGSSTPSGATGSPGSSTPSGATGSPGASPG TSSTGSPGASASGAPSTGGTSPSGESSTAPG STSSTAESPGPGTSPSGESSTAPGTSESATP ESGPGTSTEPSEGSAPGTSTEPSEGSAPGSS PSASTGTGPGSSTPSGATGSPGASPGTSSTG SPGTSTPESGSASPGTSPSGESSTAPGTSPS GESSTAPGTSESATPESGPGSEPATSGSETP GTSTEPSEGSAPGSTSESPSGTAPGSTSESP SGTAPGTSTPESGSASPGSPAGSPTSTEEGT SESATPESGPGTSTEPSEGSAPGSPAGSPTS TEEGTSESATPESGPGSEPATSGSETPGSST PSGATGSPGASPGTSSTGSPGSSTPSGATGS PGSTSESPSGTAPGTSPSGESSTAPGSTSST AESPGPGSSTPSGATGSPGASPGTSSTGSPG TPGSGTASSSPGSPAGSPTSTEEGSPAGSPT STEEGTSTEPSEGSAP | 773 | 1318 | Residue totals: H: 7 E: 0 percent: H 0.7 E: 0.0 | 99.17% |
| AM923 | MAEPAGSPTSTEEGASPGTSSTGSPGSSTPS GATGSPGSSTPSGATGSPGTSTEPSEGSAPG SEPATSGSETPGSPAGSPTSTEEGSTSSTAE SPGPGTSTPESGSASPGSTSESPSGTAPGST SESPSGTAPGSTSTPESGSASPGSTSTPESGSA SPGSEPATSGSETPGTSESATPESGPGSPAG SPTSTEEGTSTEPSEGSAPGTSESATPESGP GTSTEPSEGSAPGTSTEPSEGSAPGSPAGSP TSTEEGTSTEPSEGSAPGTSTEPSEGSAPGT SESATPESGPGTSESATPESGPGTSTEPSEG SAPGTSTEPSEGSAPGTSESATPESGPGTST EPSEGSAPGSEPATSGSETPGSPAGSPTSTE EGSSTPSGATGSPGTPGSGTASSSPGSSTPS GATGSPGTSTEPSEGSAPGTSTEPSEGSAPG SEPATSGSETPGSPAGSPTSTEEGSPAGSPT STEEGTSTEPSEGSAPGASASGAPSTGGTSE SATPESGPGSPAGSPTSTEEGSPAGSPTSTE EGSTSSTAESPGPGSTSESPSGTAPGTSPSG ESSTAPGTPGSGTASSSPGSSTPSGATGSPG SSPSASTGTGPGSEPATSGSETPGTSESATP ESGPGSEPATSGSETPGTSSTAESPGPGST SSTAESPGPGTSPSGESSTAPGSEPATSGSE TPGSEPATSGSETPGTSTEPSEGSAPGSTSS TAESPGPGTSTPESGSASPGSTSESPSGTAP GTSTEPSEGSAPGTSTEPSEGSAPGTSTEPS | 774 | 924 | Residue totals: H: 4 E: 3 percent: H: 0.4 E: 0.3 | 98.70% |

TABLE 28-continued

CHOU-FASMAN and GOR prediction calculations of secondary structure

| SEQ NAME | Sequence | SEQ ID NO: | No. Residues | Chou-Fasman Calculation | GOR Calculation |
|---|---|---|---|---|---|
| | EGSAPGSSTPSGATGSPGSSPSASTGTGPGA SPGTSSTGSPGSEPATSGSETPGTSESATPE SGPGSPAGSPTSTEEGSSTPSGATGSPGSSP SASTGTGPGASPGTSSTGSPGTSESATPESG PGTSTEPSEGSAPGTSTEPSEGSAP | | | | |
| AE912 | MAEPAGSPTSTEEGTPGSGTASSSPGSSTPS GATGSPGASPGTSSTGSPGSPAGSPISTEEG TSESATPESGPGTSTEPSEGSAPGSPAGSPT STEEGTSTEPSEGSAPGTSTEPSEGSAPGTS ESATPESGPGSEPATSGSETPGSEPATSGSE TPGSPAGSPTSTEEGTSESATPESGPGTSTE PSEGSAPGTSTEPSEGSAPGSPAbSPTSTEE GTSTEPSEGSAPGTSTEPSEGSAPGTSESAT PESGPGTSTEPSEGSAPGTSESATPESGPGS EPATSGSETPGTSTEPSEGSAPGTSTEPSEG SAPGTSESATPESGPGTSESATPESGPGSPA GSPTSTEEGTSESATPESGPGSEPATSGSET PGTSESATPESGPGISTEPSEGSAPGTSTEP SEGSAPGTSTEPSEGSAPGTSTEPSEGSAPG TSTEPSEGSAPGTSTEPSEGSAPGSPAGSPT STEEGTSTEPSEGSAPGTSESATPESGPGSE PATSGSETPGTSESATPESGPGSEPATSGSE TPGTSESATPESGPGTSTEPSEGSAPGTSES ATPESGPGSPAGSPTSTEEGSPAGSPTSTEE GSPAGSPTSTEEGTSESATPESGPGTSTEPS EGSAPGTSESATPESGPGSEPATSGSETPGT SESATPESGPGSEPATSGSETPGTSESATPE SGPGTSTEPSEGSAPGSPAGSPTSTEEGTSE SATPESGPGSEPATSGSETPGTSESATPESG PGSPAGSPTSTEEGSPAGSPTSTEEGTSTEP SEGSAPGTSESATPESGPGTSESATPESGPG TSESATPESGPGSEPATSGSETPGSEPATSG SETPGSPAGSPTSTEEGTSTEPSEGSAPGTS TEPSEGSAPGSEPATSGSETPGTSESATPES GPGTSTEPSEGSAP | 775 | 913 | Residue totals: H: 8 E: 3 percent: H: 0.9 E: 0.3 | 99.45% |
| BC 864 | GTSTEPSEPGSAGTSTEPSEPGSAGSEPATS GTEPSGSGASEPTSTEPGSEPATSGTEPSGS EPATSGTEPSGSEPATSGTEPSGSGASEPTS TEPGTSTEPSEPGSAGSEPATSGTEPSGTST EPSEPGSAGSEPATSGTEPSGSEPATSGTEP SGTSTEPSEPGSAGTSTEPSEPGSAGSEPAT SGTEPSGSEPATSGTEPSGTSEPSTSEPGAG SGASEPTSTEPGTSEPSTSEPGAGSEPATSG TEPSGSEPATSGTEPSGTSTEPSEPGSAGTS TEPSEPGSAGSGASEPTSTEPGSEPATSGTE PSGSEPATSGTEPSGSEPATSGTEPSGSEPA TSGTEPSGTSTEPSEPGSAGSEPATSGTEPS GSGASEPTSTEPGTSTEPSEPGSAGSEPATS GTEPSGSGASEPTSTEPGTSTEPSEPGSAGS GASEPTSTEPGSEPATSGTEPSGSGASEPTS TEPGSEPATSGTEPSGSGASEPTSTEPGTST EPSEPGSAGSEPATSGTEPSGSGASEPTSTE PGTSTEPSEPGSAGSEPATSGTEPSGTSTEP SEPGSAGSEPATSGTEPSGTSTEPSEPGSAG TSTEPSEPGSAGTSTEPSEPGSAGTSTEPSE PGSAGTSTEPSEPGSAGTSTEPSEPGSAGTS EPSTSEPGAGSGASEPTSTEPGTSTEPSEPG SAGTSTEPSEPGSAGTSTEPSEPGSAGSEPA TSGTEPSGSGASEPTSTEPGSEPATSGTEPS GSEPATSGTEPSGSEPATSGTEPSGSEPATS GTEPSGTSEPSTSEPGAGSEPATSGTEPSGS GASEPTSTEPGTSTEPSEPGSAGSEPATSGT EPSGSGASEPTSTEPGTSTEPSEPGSA | 776 | | Residue totals: H: 0 E: 0 percent: H: 0 E: 0 | 99.77% |
| | ASPAAPAPASPAAPAPSAPAAAPASPAPAAP SAPAPAAPSAASPAAPSAPPAAASPAAPSAP PAASAAAPAXASAAASAPSAAA | 777 | 84 | Residue totals: H: 58 E: 0 percent: H: 69.0 E: 0.0 | 78.57% |

*H: alpha-helix E: beta-sheet

Example 40

Analysis of Polypeptide Sequences for Repetitiveness

Polypeptide amino acid sequences can be assessed for repetitiveness by quantifying the number of times a shorter subsequence appears within the overall polypeptide. For example, a polypeptide of 200 amino acid residues has 192 overlapping 9-amino acid subsequences (or 9-mer "frames"), but the number of unique 9-mer subsequences will depend on the amount of repetitiveness within the sequence. In the present analysis, different sequences were assessed for repetitiveness by summing the occurrence of all unique 3-mer subsequences for each 3-amino acid frame across the first 200 amino acids of the polymer portion divided by the absolute number of unique 3-mer subsequences within the 200 amino acid sequence. The resulting subsequence score is a reflection of the degree of repetitiveness within the polypeptide.

The results, shown in Table 29, indicate that the unstructured polypeptides consisting of 2 or 3 amino acid types have high subsequence scores, while those of consisting of 12 amino acids motifs of the six amino acids G, S, T, E, P, and A with a low degree of internal repetitiveness, have subsequence scores of less than 10, and in some cases, less than 5. For example, the L288 sequence has two amino acid types and has short, highly repetitive sequences, resulting in a subsequence score of 50.0. The polypeptide J288 has three amino acid types but also has short, repetitive sequences, resulting in a subsequence score of 33.3. Y576 also has three amino acid types, but is not made of internal repeats, reflected in the subsequence score of 15.7 over the first 200 amino acids. W576 consists of four types of amino acids, but has a higher degree of internal repetitiveness, e.g., "GGSG" (SEQ ID NO: 778), resulting in a subsequence score of 23.4. The AD576 consists of four types of 12 amino acid motifs, each consisting of four types of amino acids. Because of the low degree of internal repetitiveness of the individual motifs, the overall subsequence score over the first 200 amino acids is 13.6. In contrast, XTEN's consisting of four motifs contains six types of amino acids, each with a low degree of internal repetitiveness have lower subsequence scores; i.e., AE864 (6.1), AF864 (7.5), and AM875 (4.5).

Conclusions:

The results indicate that the combination of 12 amino acid subsequence motifs, each consisting of four to six amino acid types that are essentially non-repetitive, into a longer XTEN polypeptide results in an overall sequence that is non-repetitive. This is despite the fact that each subsequence motif may be used multiple times across the sequence. In contrast, polymers created from smaller numbers of amino acid types resulted in higher subsequence scores, although the actual sequence can be tailored to reduce the degree of repetitiveness to result in lower subsequence scores.

TABLE 29

Subsequence score calculations of polypeptide sequences

| Seq Name | Amino Acid Sequence | SEQ ID NO: | Score |
|---|---|---|---|
| J288 | GSGGEGGSGGEGGSGGEGGSGGEGGSGGEGGSGGEGGSGGEGGSGGEGGSGGEG GSGGEGGSGGEGGSGGEGGSGGEGGSGGEGGSGGEGGSGGEGGSGGEGGSGGEG GSGGEGGSGGEGGSGGEGGSGGEGGSGGEGGSGGEGGSGGEGGSGGEGGSGGEG GSGGEGGSGGEGGSGGEGGSGGEGGSGGEGGSGGEGGSGGEGGSGGEGGSGGEG GSGGEGGSGGEGGSGGEGGSGGEGGSGGEGGSGGEGGSGGEGGSGGEGGSGGEG GSGGEGGSGGEGGSGGEG | 779 | 33.3 |
| K288 | GEGEGGGEGGEGEGGGEGGEGEGGGEGGEGEGGGEGGEGEGGGEGGEGEGGGEG GEGEGGGEGGEGEGGGEGGEGEGGGEGGEGEGGGEGGEGEGGGEGGEGEGGGEG GEGEGGGEGGEGEGGGEGGEGEGGGEGGEGEGGGEGGEGEGGGEGGEGEGGGEG GEGEGGGEGGEGEGGGEGGEGEGGGEGGEGEGGGEGGEGEGGGEGGEGEGGGEG GEGEGGGEGGEGEGGGEGGEGEGGGEGGEGEGGGEGGEGEGGGEGGEGEGGGEG GEGEGGGEGGEGEGGGEG | 780 | 46.9 |
| L288 | SSESSESSSSESSSSESSESSSSESSSSESSESSSSESSSSESSESSSSESSSSESSE SSSSESSSSESSESSSSESSSSESSESSSSESSSSESSESSSSESSSSESSESSSSES SSESSESSSSESSSSESSESSSSESSSSESSESSSSESSSSESSESSSSESSSSESSE SSSSESSSSESSESSSSESSSSESSESSSSESSSSESSESSSSESSSSESSESSSSES SSESSESSSSESSSSESSESSSSESSSSESSESSSSESSSSESSESSSSESSSSESSE SSSSESSSSESSESSSSES | 781 | 50.0 |
| Y288 | GEGSGEGSEGEGSEGSGEGEGSEGSGEGEGGSEGSEGEGGSEGSEGEGGSEGSE GEGSGEGSEGEGGSEGSEGEGSGEGSEGEGSEGGSEGEGGSEGSEGEGSGEGSE GEGGEGGSEGEGSEGSGEGEGSGEGSEGEGSEGSGEGEGSGEGSEGEGSEGSGE GEGSEGSGEGEGSEGSGEGEGSEGSGEGEGGSEGSEGEGGSEGSEGEGGSEGSE GEGSGEGGEGEGSEGSEGGSEGEGGSEGSGEGEGSEGGSEGEGSEGGSE GEGSEGSGEGEGSEGSGE | 782 | 26.8 |
| Q576 | GGKPGEGGKPEGGGGKPGGKPEGEGEGKPGGKPEGGGKPGGGEGGKPEGGKPEG EGKPGGGEGKPGGKPEGGGGKPEGEGKPGGGGGKPGGKPEGEGKPGGGEGGKPE GKPGEGGEGKPGGKPEGGGEGKPGGGKPGEGGKPGEGKPGGGEGGKPEGGKPEG EGKPGGGEGKPGGKPGEGGKPEGGGEGKPGGKPGEGGEGKPGGGKPEGEGKPGG GKPGGGEGGKPEGEGKPGGKPEGGGEGKPGGKPEGGGKPEGGGEGKPGGGKPGE GGKPGEGEGKPGGKPEGEGKPGGGGGKPEGKPGGGEGGKPEGGKPGEGGKPEG GKPGEGGEGKPGGGKPGEGGKPEGGGKPEGEGKPGGGGKPGEGGKPEGGKPEGG GEGKPGGGKPEGEGKPGGGEGKPGGKPEGGGGKPGEGGKPEGGKPGGEGGGKPE GEGKPGGKPGEGGGGKPGGKPEGEGKPGEGGEGKPGGKPEGGGEGKPGGKPEGG GEGKPGGGKPGEGGKPEGGGKPGEGGKPEGEGKPGGGEGKPGGKPGEG GKPEGGGEGKPGGKPGGEGGGKPEGGKPGEGGKPEG | 783 | 18.5 |

TABLE 29-continued

Subsequence score calculations of polypeptide sequences

| Seq Name | Amino Acid Sequence | SEQ ID NO: | Score |
|---|---|---|---|
| U576 | GEGKPGGKPGSGGGKPGEGGKPGSGEGKPGGKPGSGGSGKPGGKPGEGGKPEGG SGGKPGGGGKPGGKPGGEGSGKPGGKPEGGGKPEGGSGGKPGGKPEGGSGGKPG GKPGSGEGGKPGGGKPGGEGKPGSGKPGGEGSGKPGGKPEGGGKPGGKPEGG SGGKPGGSGKPGGKPGEGGKPEGGSGGKPGGSGKPGGKPEGGGSGKPGGKPGEG GKPGSGEGGKPGGGKPGGEGKPGSGKPGGEGSGKPGGKPGSGGEGKPGGKPEGG SGGKPGGGKPGGEGKPGSGGKPGEGGKPGSGGGKPGGKPGGEGEGKPGGKPGEG GKPGGEGSGKPGGGGKPGGKPGGEGGKPEGSGKPGGGSGKPGGKPEGGGGKPEG SGKPGGGGKPEGSGKPGGKPEGGSGGKPGGSGKPGGKPGEGGGKPEGSGKPGG GSGKPGGKPEGGGKPEGGSGGKPGGKPEGGSGGKPGGKPGGEGSGKPGGKPGSG EGGKPGGKPGEGSGGKPGGKPEGGSGGKPGGSGKPGGKPEGGGSGKPGGKPGEG GKPGGEGSGKPGGSGKPG | 784 | 18.1 |
| W576 | GGSGKPGKPGGSGSGKPGSGKPGGGSGKPGSGKPGGGSGKPGSGKPGGGSGKPG SGKPGGGGKPGSGSGKPGGGKPGGSGKPGGGSGKPGKPGSGGSGKPGSGKPGG GSGGKPGKPGSGGSGGKPGKPGSGGGSGKPGKPGSGGSGGKPGKPGSGGSGKP GKPGSGGSGKPGSGKPGGGSGKPGSGKPGSGGSGKPGKPGSGGSGKPGSGKPGS GSGKPGSGKPGGGSGKPGSGKPGSGGSGKPGKPGSGGGKPGSGSGKPGGGKPGS GSGKPGGGKPGGSGGKPGSGGKPGKPGSGGGSGKPGKPGSGGGKPGS GSGKPGSGKPGGGSGKPGSGKPGSGGSGKPGKPGSGGSGGKPGKPGSGGGKPGS GSGKPGGGKPGSGGGKPGSGSGKPGGGKPGSGGSGKPGSGKPGGGSGKPGG GSGGKPGKPGSGGSGKPGSGKPGSGGSGKPGKPGGSGSGKPGSGKPGGGSGKPG SGKPGGGSGKPGSGKPGGGSGKPGSGKPGGGGKPGSGSGKPGGSGGKPGKPGSG GSGGKPGKPGSGGSGKPGSGKPGGGSGGKPGKPGSGG | 785 | 23.4 |
| Y576 | GEGSGEGSEGEGSEGSGEGEGSEGSGEGEGGSEGSEGEGSEGSGEGEGGSE GEGSGEGSEGEGGGEGSEGEGSGEGGEGEGSEGGSEGEGSEGGEGEGSEGSGE GEGSEGGSEGEGSEGGSEGEGSEGSGEGEGSEGSGEGEGSEGSGEGEGSEGSGE GEGSEGGSEGEGGEGSEGEGSEGSGEGEGSEGSGEGGGEGSEGEGSEGSGE GEGGSEGSEGEGSEGSGEGEGSEGSGEGEGSEGGGEGSEGEGSEGSGEGSE GEGSEGSGEGEGSGEGSEGEGSEGSGEGEGSEGSGEGEGSEGSGEGEGSEGSGE GEGGSEGSEGEGSEGSGEGEGSEGSGEGEGSEGSGEGEGSEGSGEGEGSEGSGE GEGSEGSGEGEGSEGSEGSEGEGSEGSEGEGSEGSGEGEGSEGSGEGEGGSE GEGSEGSGEGEGSEGSGEGEGSEGSGEGEGGSEGGEGEGSEGGEGEGSEGGSE GEGGEGSGEGEGGGEGSEGEGSEGSGEGEGSGEGSE | 786 | 15.7 |
| AD576 | GSSESGSSEGGPGSGGEPSEGSGGSSESGSSEGGPGSSESGSSEGGPGSSESG SSEGGPGSSESGSSEGGPGSSESGSSEGGPGESPGGSSGSESGSEGSSGPGESS GSSESGSSEGGPGSSESGSSEGGPGSSESGSSEGGPGSGGEPSEGSGSSGESPGG SSGSESGESPGGSSGSESGSGGEPSEGSGSSGSSESGSSEGGPGSGGEPSESGSS GSGGEPSESGSSGESSGPGESSGESPGGSSGESGSPGGSSESGESPGGSSGSGGEP SESGSGSGGEPSESGSSGSSESGSSEGGPGESPGGSSGSESGESPGGSSGSES GESPGGSSGSESGESPGGSSGSESGESPGGSSGSESGSSEGGPGSGGEP SESGSSGSEGSSGPGESSGSSESGSSEGGPGSGGEPSESGSSGSSESGSSEGGP GSGGEPSESGSSGESPGGSSGSESGESPGGSSGSESGSSGPGSGGEP SESGSSGSSESGSSEGGPGSGGEPSESGSSGSGGEPSESGSSGESPGGSSGSES GSEGSSGPGESSGSSESGSSEGGPGSEGSSGPGESS | 787 | 13.6 |
| AE576 | AGSPAGSPTSTEEGTSESATPESGPGTSTEPSEGSAPGSPAGSPTSTEEGTSTE PSEGSAPGTSTEPSEGSAPGTSESATPESGPGSEPATSGSETPGSEPATSGSET PGSPAGSPTSTEEGTSESATPESGPGTSTEPSEGSAPGSPAG SPTSTEEGTSTEPSEGSAPGTSTEPSEGSAPGTSESATPESGPGTSTEPSEGSA PGTSESATPESGPGSEPATSGSETPGTSTEPSEGSAPGTSTEPSEGSAPGTSES ATPESGPGTSESATPESGPGSPAGSPTSTEEGTSESATPESGPGSEPATSGSET PGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSA PGTSESATPESGPGSEPATSGSETPGTSESATPESGPGSEPATSGSETPGTSES ATPESGPGTSTEPSEGSAPGTSESATPESGPGSPAGSPTSTEEGSPAGSPTSTE EGSPAGSPTSTEEGTSESATPESGPGTSTEPSEGSAP | 788 | 6.1 |
| AF540 | GSTSSTAESPGPGSTSSTAESPGPGSTSESPSGTAPGSTSSTAESPGPGSTSST AESPGPGTSTPESGSASPGSTSESPSGTAPGTSPSGESSTAPGSTSESPSGTAP GSTSESPSGTAPGTSPSGESSTAPGSTSESPSGTAPGSTSESPSGTAPGTSPSG ESSTAPGSTSESPSGTAPGSTSESPSGTAPGSTSESPSGTAPGTSTPESGSASP GSTSESPSGTAPGSTSTPESGSASPGSTSSTAESPGPGSTSSTAESPGPGTSTPE SGSASPGTSTPESGSASPGSTSESPSGTAPGSTSTPESGSASPGSTSESPSGASP GSTSESPSGTAPGSTSESPSGTAPGSTSSTAESPGPGTSTPE SGSASPGTSTPESGSASPGSTSESPSGTAPGSTSESPSGTAPGTSTPESGSASP GSTSESPSGTAPGSTSESPSGTAPGTSTPESGSASPGTSPSGESSTAPGSTSST AESPGPGTSPSGESSTAPGSTSSTAESPGPGTSTPESGSASPGTSESPSGTAP | 789 | 8.8 |
| AF504 | GASPGTSSTGPSGSSPSASTGTGPGSSPSASTGTGPGTPGSGTASSSPGSSTPS GATGSPGSNPSASTGTGPGASPGTSSTGSPGTPGSGTASSSPGSSTPSGATGSP GTPGSGTASSSPGASPGTSSTGSPGASPGTSSTGSPGTPGSGTASSSPGSSTPS GATGSPGASPGTSSTGSPGTPGSGTASSSPGSSTPSGATGSPGSNPSASTGTGP | 790 | 7.0 |

TABLE 29-continued

Subsequence score calculations of polypeptide sequences

| Seq Name | Amino Acid Sequence | SEQ ID NO: | Score |
|---|---|---|---|
| | GSSPSASTGTGPGSSTPSGATGSPGSSTPSGATGSPGASPGTSSTGSPGASPGT SSTGSPGASPGTSSTGSPGTPGSGTASSSPGASPGTSSTGSPGASPGTSSTGSP GASPGTSSTGSPGSSPSASTGTGPGTPGSGTASSSPGASPGTSSTGSPGASPGT SSTGSPGASPGTSSTGSPGSSTPSGATGSPGSSTPSGATGSPGASPGTSSTGSP GTPGSGTASSSPGSSTPSGATGSPGSSTPSGATGSPGSSTPSGATGSPGSSPSA STGTGPGASPGTSSTGSP | | |
| AE864 | GSPAGSPTSTEEGTSESATPESGPGTSTEPSEGSAPGSPAGSPTSTEEGTSTEP SEGSAPGTSTEPSEGSAPGTSESATPESGPGSEPATSGSETPGSEPATSGSETP GSPAGSPTSTEEGTSESATPESGPGTSTEPSEGSAPGTSTEPSEGSAPGSPAGS PTSTEEGTSTEPSEGSAPGTSTEPSEGSAPGTSESATPESGPGTSTEPSEGSAP GTSESATPESGPGSEPATSGSETPGTSTEPSEGSAPGTSTEPSEGSAPGTSESA TPESGPGTSESATPESGPGSPAGSPTSTEEGTSESATPESGPGSEPATSGSETP GTSESATPESGPGTSTEPSEGSAPGTSTEPSEGSAPGTSTEPSEGSAPGTSTEP SEGSAPGTSTEPSEGSAPGTSTEPSEGSAPGSPAGSPTSTEEGTSTEPSEGSAP GTSESATPESGPGSEPATSGSETPGTSESAPESGPGSEPATSGSETPGTSESA TPESGPGTSTEPSEGSAPGTSESATPESGPGSPAGSPTSTEEGSPAGSPTSTEE GSPAGSPTSTEEGTSESATPESGPGTSTEPSEGSAPGTSESATPESGPGSEPAT SGSETPGTSESATPESGPGSEPATSGSETPGTSESATPESGPGTSTEPSEGSAP GSPAGSPTSTEEGTSESATPESGPGSEPATSGSETPGTSESATPESGPGSPAGS PTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEP SEGSAP | 791 | 6.1 |
| AF864 | GSTSESPSGTAPGTSPSGESSTAPGSTSESPSGTAPGSTSESPSGTAPGTSTPE SGSASPGTSTPESGSASPGSTSESPSGTAPGSTSESPSGTAPGTSPSGESSTAP GSTSESPSGTAPGTSPSGESSTAPGTSPSGESSTAPGSTSTAESPGPGTSPSG ESSTAPGTSPSGESSTAPGSTSSTAESPGPGTSTPESGSASPGTSTPESGSASP GSTSESPSGTAPGSTSESPSGTAPGTSTPESGSASPGTSSTAESPGPGTSTPE SGSASPGTSESPSGTAPGTSPSGESSTAPGSTSSTAESPGPGTSPSGESSTAP GTSTPESGSASPGTSSTAESPGPGTSSTAESPGPGTSSTAESPGPGTSSST AESPGPGTSPSGESSTAPGSTSESPSGTAPGSTSESPSGTAPGTSTPESGPXXX GASASGAPSTXXXXSESPSGTAPGSTSESPSGTAPGSTSESPSGTAPGSTSESP SGTAPGSTSESPSGTAPGSTSESPSGTAPGTSTPESGSASPGTSPSGESSTAPG TSPSGESSTAPGSTSSTAESPGPGTSPSGESSTAPGTSTPESGSASPGSTSESP SGTAPGSTSESPSGTAPGTSPSGESSTAPGSTSESPSGTAPGTSTPESGSASPG TSTPESGSASPGSTSESPSGTAPGTSTPESGSASPGSTSSTAESPGPGSTSESP SGTAPGSTSESPSGTAPGTSPSGESSTAPGSTSSTAESPGPGTSPSGESSTAPG TSTPESGSASPGTSPSGESSTAPGTSPSGESSTAPGTSPSGESSTAPGSTSSTA ESPGPGTSSTAESPGPGTSPSGESSTAPGSSPSASTGTGPGSSTPSGATGSPG SSTPSGATGSP | 792 | 7.5 |
| AG868 | GGSPGASPGTSSTGSPGSSPSASTGTGPGSSPSASTGTGPGTPGSGTASSSPGS STPSGATGSPGSNPSASTGTGPGASPGTSSTGSPGTPGSGTASSSPGSSTPSGA TGSPGTPGSGTASSSPGASPGTSSTGSPGASPGTSSTGSPGTPGSGTASSSPGS STPSGATGSPGASPGTSSTGSPGTPGSGTASSSPGSSTPSGATGSPGSNPSAST GTGPGSSPSASTGTGPGSSTPSGATGSPGSSTPSGATGSPGASPGTSSTGSPGA SPGTSSTGSPGASPGTSSTGSPGTPGSGTASSSPGASPGTSSTGSPGASPGTSS TGSPGASPGTSSTGSPGSSPSASTGTGPGTPGSGTASSSPGASPGTSSTGSPGA SPGTSSTGSPGASPGTSSTGSPGSSTPSGATGSPGSSTPSGATGSPGASPGTSS TGSPGTPGSGTASSSPGSSTPSGATGSPGSSTPSGATGSPGSSTPSGATGSPGS SPSASTGTGPGASPGTSSTGSPGASPGTSSTGSPGTPGSGTASSSPGASPGTSS TGSPGASPGTSSTGSPGASPGTSSTGSPGASPGTSSTGSPGTPGSGTASSSPGS STPSGATGSPGTPGSGTASSSPGSSTPSGATGSPGTPGSGTASSSPGSSTPSGA TGSPGSSTPSGATGSPGSSPSASTGTGPGSSPSASTGTGPGASPGTSSTGSPGT PGSGTASSSPGSSTPSGATGSPGSSPSASTGTGPGSSPSASTGTGPGASPGTSS TGSPGASPGTSSTGSPGSSTPSGATGSPGSSPSASTGTGPGASPGTSSTGSPGS SPSASTGTGPGTPGSGTASSSPGSSTPSGATGSPGSSTPSGATGSPGASPGTSS TGSP | 793 | 7.5 |
| AM875 | GTSTEPSEGSAPGSEPATSGSETPGSPAGSPTSTEEGTSSTAESPGPGTSTPE SGSASPGTSTSESPSGTAPGTSESPSGTAPGTSTPESGSASPGTSTPESGSASP GSEPATSGSETPGTSESATPESGPGSPAGSPTSTEEGTSTEPSEGSAPGTSESA TPESGPGTSTEPSEGSAPGTSTEPSEGSAPGSPAGSPTSTEEGTSTEPSEGSAP GTSTEPSEGSAPGTSESATPESGPGTSESATPESGPGTSTEPSEGSAPGTSTEP SEGSAPGTSESATPESGPGTSTEPSEGSAPGSEPATSGSETPGSPAGSPTSTEE GSSTPSGATGSPGTPGSGTASSSPGSSTPSGATGSPGTSTEPSEGSAPGTSTEP SEGSAPGSEPATSGSETPGSPAGSPTSTEEGSPAGSPTSTEEGTSTEPSEGSAP GASASGAPSTGGTSESATPESGPGSPAGSPTSTEEGSPAGSPTSTEEGSTSSTA | 794 | 4.5 |

TABLE 29-continued

Subsequence score calculations of polypeptide sequences

| Seq Name | Amino Acid Sequence | SEQ ID NO: | Score |
|---|---|---|---|
| | ESPGPGSTSESPSGTAPGTSPSGESSTAPGTPGSGTASSSPGSSTPSGATGSPG SSPSASTGTGPGSEPATSGSETPGTSESATPESGPGSEPATSGSETPGSTSSTA ESPGPGSTSSTAESPGPGTSPSGESSTAPGSEPATSGSETPGSEPATSGSETPG TSTEPSEGSAPGSTSSTAESPGPGTSTPESGSASPGSTSESPSGTAPGTSTEPS EGSAPGTSTEPSEGSAPGTSTEPSEGSAPGSSTPSGATGSPGSSPSASTGTGPG ASPGTSSTGSPGSEPATSGSETPGTSESATPESGPGSPAGSPTSTEEGSSTPSG ATGSPGSSPSASTGTGPGASPGTSSTGSPGTSESATPESGPGTSTEPSEGSAPG TSTEPSEGSAP | | |
| AM1318 | GTSTEPSEGSAPGSEPATSGSETPGSPAGSPTSTEEGSTSSTAESPGPGTSTPE SGSASPGTSESPSGTAPGSTSESPSGTAPGTSTPESGSASPGTSTPESGSASP GSEPATSGSETPGTSESATPESGPGSPAGSPTSTEEGTSTEPSEGSAPGTSESA TPESGPGTSTEPSEGSAPGTSTEPSEGSAPGSPAGSPTSTEEGTSTEPSEGSAP GTSTEPSEGSAPGTSESATPESGPGTSESATPESGPGTSTEPSEGSAPGTSTEP SEGSAPGTSESATPESGPGTSTEPSEGSAPGSEPATSGSETPGSPAGSPTSTEE GSSTPSGATGSPGTPGSGTASSSPGSSTPSGATGSPGTSTEPSEGSAPGTSTEP SEGSAPGSEPATSGSETPGSPAGSPTSTEEGSPAGSPTSTEEGTSTEPSEGSAP GPEPTGPAPSGGSEPATSGSETPGTSESATPESGPGSPAGSPTSTEEGTSESAT PESGPGSPAGSPTSTEEGSPAGSPTSTEEGTSESATPESGPGSPAGSPTSTEEG SPAGSPTSTEEGSTSSTAESPGPGSTSESPSGTAPGTSPSGESSTAPGSTSESP SGTAPGSTSESPSGTAPGTSPSGESSTAPGTSTEPSEGSAPGTSESATPESGPG TSESATPESGPGSEPATSGSETPGTSESATPESGPGTSESATPESGPGTSTEPS EGSAPGTSESATPESGPGTSTEPSEGSAPGTSPSGESSTAPGTSPSGESSTAPG TSPSGESSTAPGTSTEPSEGSAPGSPAGSPTSTEEGTSTEPSEGSAPGSSPSAS TGTGPGSSTPSGATGSPGSSTPSGATGSPGSSTPSGATGSPGSSTPSGATGSPG ASPGTSSTGSPGASASGAPSTGGTSPSGESSTAPGSTSSTAESPGPGTSPSGES STAPGTSESATPESGPGTSTEPSEGSAPGTSTEPSEGSAPGSSPSASTGTGPGS STPSGATGSPGASPGTSSTGSPGTSTPESGSASPGTSPSGESSTAPGTSPSGES STAPGTSESATPESGPGSEPATSGSETPGTSTEPSEGSAPGTSESPSGTAPGS TSESPSGTAPGTSTPESGSASPGSPAGSPTSTEEGTSESATPESGPGTSTEPSE GSAPGSPAGSPTSTEEGTSESATPESGPGSEPATSGSETPGSSTPSGATGSPGA SPGTSSTGSPGSSTPSGATGSPGSTSESPSGTAPGTSPSGESSTAPGSTSSTAE SPGPGSSTPSGATGSPGASPGTSSTGSPGTPGSGTASSSPGSPAGSPTSTEEGS PAGSPTSTEEGTSTEPSEGSAP | 795 | 4.5 |

Example 41

Calculation of TEPITOPE Scores

TEPITOPE scores of 9 mer peptide sequence can be calculated by adding pocket potentials as described by Sturniolo [Sturniolo, T., et al. (1999) Nat Biotechnol, 17: 555]. In the present Example, separate Tepitope scores were calculated for individual HLA alleles. Table 30 shows as an example the pocket potentials for HLA*0101B, which occurs in high frequency in the Caucasian population. To calculate the TEPITOPE score of a peptide with sequence P1-P2-P3-P4-P5-P6-P7-P8-P9, the corresponding individual pocket potentials in Table 30 were added. The HLA*0101B score of a 9 mer peptide with the sequence FDKLPRTSG (SEQ ID NO: 796) would be the sum of 0, −1.3, 0, 0.9, 0, −1.8, 0.09, 0, 0.

To evaluate the TEPITOPE scores for long peptides one can repeat the process for all 9 mer subsequences of the sequences. This process can be repeated for the proteins encoded by other HLA alleles. Tables 31-34 give pocket potentials for the protein products of HLA alleles that occur with high frequency in the Caucasian population.

TEPITOPE scores calculated by this method range from approximately −10 to +10. However, 9 mer peptides that lack a hydrophobic amino acid (FKLMVWY (SEQ ID NO: 797)) in P1 position have calculated TEPITOPE scores in the range of −1009 to −989. This value is biologically meaningless and reflects the fact that a hydrophobic amino acid serves as an anchor residue for HLA binding and peptides lacking a hydrophobic residue in P1 are considered non binders to HLA. Because most XTEN sequences lack hydrophobic residues, all combinations of 9 mer subsequences will have TEPITOPEs in the range in the range of −1009 to −989. This method confirms that XTEN polypeptides may have few or no predicted T-cell epitopes.

Lengthy table referenced here

US08957021-20150217-T00001

Please refer to the end of the specification for access instructions.

Lengthy table referenced here

US08957021-20150217-T00002

Please refer to the end of the specification for access instructions.

Lengthy table referenced here

US08957021-20150217-T00003

Please refer to the end of the specification for access instructions.

| Lengthy table referenced here |
| --- |
| US08957021-20150217-T00004 |
| Please refer to the end of the specification for access instructions. |

| Lengthy table referenced here |
| --- |
| US08957021-20150217-T00005 |
| Please refer to the end of the specification for access instructions. |

| Lengthy table referenced here |
| --- |
| US08957021-20150217-T00006 |
| Please refer to the end of the specification for access instructions. |

| Lengthy table referenced here |
| --- |
| US08957021-20150217-T00007 |
| Please refer to the end of the specification for access instructions. |

| Lengthy table referenced here |
| --- |
| US08957021-20150217-T00008 |
| Please refer to the end of the specification for access instructions. |

| Lengthy table referenced here |
| --- |
| US08957021-20150217-T00009 |
| Please refer to the end of the specification for access instructions. |

LENGTHY TABLES

The patent contains a lengthy table section. A copy of the table is available in electronic form from the USPTO web site (http://seqdata.uspto.gov/?pageRequest=docDetail&DocID=US08957021B2). An electronic copy of the table will also be available from the USPTO upon request and payment of the fee set forth in 37 CFR 1.19(b)(3).

SEQUENCE LISTING (1343 sequences)

SEQ ID NO: 1 - protein, 37 aa, Rattus sp.
KCNTATCATQRLANFLVRSSNNLGPVLPPTNVGSNTY

SEQ ID NO: 2 - protein, 37 aa, Homo sapiens [sequence omitted]

SEQ ID NO: 3 - protein, 39 aa, Heloderma horridum
HSDGTFTSDLSKQMEEEAVRLFIEWLKNGGPSSGAPPPS

SEQ ID NO: 4 - protein, 39 aa, Heloderma suspectum
HGEGTFTSDLSKQMEEEAVRLFIEWLKNGGPSSGAPPPS

SEQ ID NO: 5 - protein, 29 aa, Unknown
  Description of Unknown: Glucagon peptide
HSQGTFTSDYSKYLDSRRAQDFVQWLMNT

SEQ ID NO: 6 - protein, 37 aa, Unknown
  Description of Unknown: Glucagon-like peptide-1
HDEFERHAEGTFTSDVSSTLEGQAALEFIAWLVKGRG

SEQ ID NO: 7 - protein, 30 aa, Homo sapiens
HAEGTFTSDVSSYLEGQAALEFIAWLVKGR

SEQ ID NO: 8 - protein, 31 aa, Homo sapiens
HAEGTFTSDVSSTLEGQAALEFIAWLVKGRG

SEQ ID NO: 9 - protein, 37 aa, Unknown
  Description of Unknown: Frog glucagon like peptide-1
HAEGTYTNDVTEYLEEKAAKEFIEWLIKGKPKKIRYS

SEQ ID NO: 10 - protein, 33 aa, Homo sapiens
HADGSFSDEMNTILDNLAARDFINWLIETKITD

SEQ ID NO: 11 - protein, 31 aa, Unknown
  Description of Unknown: Frog glucagon like peptide-2
HAEGTFTNDMTNYLEEKAAKEFVGWLIKGRP

SEQ ID NO: 12 - protein, 37 aa, Artificial Sequence
  Description of Artificial Sequence: Synthetic polypeptide
KCNTATCATNRLANFLVHSSNNFGPILPPTNVGSNTY

SEQ ID NO: 13 - protein, 37 aa, Artificial Sequence
  Description of Artificial Sequence: Synthetic polypeptide
  MOD_RES (10)..(10): Asn or Gln
  MOD_RES (25)..(25): Ser, Pro, or Gly
  MOD_RES (28)..(29): Ser, Pro, or Gly
KCNTATCATXRLANFLVHSSNNFGXILXXTNVGSNTY

SEQ ID NO: 14 - protein, 37 aa, Artificial Sequence
  Description of Artificial Sequence: Synthetic polypeptide
KCNTATCATNRLANFLVHSSNNFGGILGGTNVGSNTY

SEQ ID NO: 15 - protein, 37 aa, Artificial Sequence; identical to SEQ ID NO: 14
  Description of Artificial Sequence: Synthetic polypeptide

SEQ ID NO: 16 - protein, 39 aa, Heloderma suspectum; identical to SEQ ID NO: 4

SEQ ID NO: 17 - protein, 37 aa, Unknown; identical to SEQ ID NO: 9
  Description of Unknown: Frog glucagon like peptide-1

SEQ ID NO: 18 - protein, 37 aa, Xenopus laevis
HAEGTFTSDVTQQLDEKAAKEFIDWLINGGPSKEIIS

SEQ ID NO: 19 - protein, 33 aa, Xenopus laevis
HAEGTYTNDVTEYLEEKAAKEFIIEWLIKGKPK

SEQ ID NO: 20 - protein, 32 aa, Xenopus laevis
HAEGTFTNDMTNYLEEKAAKEFVGWLIKGRPK

SEQ ID NO: 21 - protein, 27 aa, Mus musculus
HAEGTFISDYSIAMDKIRQQDFVNWLL

SEQ ID NO: 22 - protein, 27 aa, Equus caballus
HAEGTFISDYSIAMDKIRQQDFVNWLL

SEQ ID NO: 23 - protein, 32 aa, Petromyzon marinus
HADGTFTNDMTSYLDAKAARDFVSWLARSDKS

SEQ ID NO: 24 - protein, 30 aa, Anguilla rostrata
HAEGTYTSDVSSYLQDQAAKEFVSWLKTGR

SEQ ID NO: 25 - protein, 30 aa, Anguilla anguilla; identical to SEQ ID NO: 24

SEQ ID NO: 26 - protein, 38 aa, Hydrolagus colliei
HADGIYTSDVASLTDYLKSKRFVESLSNYNKRQNDRRM

SEQ ID NO: 27 - protein, 31 aa, Amia calva
YADAPYISDVYSYLQDQVAKKWLKSGQDRRE

SEQ ID NO: 28 - protein, 28 aa, Unknown
  Description of Unknown: Glucagon like peptide-1
HADGTYTSDVSSYLQEQAAKDFITWLKS

SEQ ID NO: 29 - protein, 28 aa, Unknown
  Description of Unknown: Glucagon like peptide-1
HAEGTYTSDVSSYLQDQAAKEFVSWLKT

SEQ ID NO: 30 - protein, 28 aa, Unknown
  Description of Unknown: Glucagon like peptide-1
HAEGTFTSDVSSYLEGQAAKEFIAWLVK

SEQ ID NO: 31 - protein, 28 aa, Unknown
  Description of Unknown: Glucagon like peptide-1
HADGTFTSDVSSYLKDQAIKDFVDRLKA

SEQ ID NO: 32 - protein, 28 aa, Unknown
  Description of Unknown: Glucagon like peptide-1
HADGIYTSDVASLTDYLKSKRFVESLSN

SEQ ID NO: 33 - protein, 28 aa, Unknown
  Description of Unknown: Glucagon like peptide-1
HSQGTFTSDYSKYLDSRRAQQFLKWLLN

SEQ ID NO: 34 - protein, 28 aa, Unknown
  Description of Unknown: Glucagon like peptide-1
HSQGTFTSDYSKHLDSRYAQEFVQWLMN

SEQ ID NO: 35 - protein, 28 aa, Unknown
  Description of Unknown: Glucagon like peptide-1
HSEGTFSNDYSKYLEDRKAQEFVRWLMN

SEQ ID NO: 36 - protein, 28 aa, Unknown
  Description of Unknown: Glucagon like peptide-1
HTDGIFSSDYSKYLDNRRTKDFVQWLLS

SEQ ID NO: 37 - protein, 28 aa, Unknown
  Description of Unknown: Glucagon like peptide-1
HSEGTFSSDYSKYLDSRRAKDFVQWLMS

SEQ ID NO: 38 - protein, 28 aa, Unknown
  Description of Unknown: Glucagon like peptide-1
YAEGTFISDYSIAMDKIRQQDFVNWLLA

SEQ ID NO: 39 - protein, 28 aa, Unknown
  Description of Unknown: Glucagon like peptide-1
HADGIFTTVYSHLLAKLAVKRYLHSLIR

SEQ ID NO: 40 - protein, 28 aa, Unknown
  Description of Unknown: Glucagon like peptide-1
HIDGIFTDSYSRYRKQMAVKKYLAAVLG

SEQ ID NO: 41 - protein, 28 aa, Unknown
  Description of Unknown: Glucagon like peptide-1
HSDALFTDTYTRLRKQMAMKKYLNSVLN

SEQ ID NO: 42 - protein, 28 aa, Unknown
  Description of Unknown: Glucagon like peptide-1
HSDAVFTDSYTRLLKQMAMRKYLDSILN

SEQ ID NO: 43 - protein, 28 aa, Unknown
  Description of Unknown: Glucagon like peptide-1
HSDATFTAEYSKLLAKLALQKYLESILG

SEQ ID NO: 44 - protein, 28 aa, Unknown
  Description of Unknown: Glucagon like peptide-1
YADAIFTNSYRKVLGQLSARKLLQDIMN

SEQ ID NO: 45 - protein, 28 aa, Unknown
  Description of Unknown: Glucagon like peptide-1
HADAIFTSSYRRILGQLYARKLLHEIMN

SEQ ID NO: 46 - protein, 28 aa, Unknown
  Description of Unknown: Glucagon like peptide-1
HVDAIFTTNYRKLLSQLYARKVIQDIMN

SEQ ID NO: 47 - protein, 28 aa, Unknown
  Description of Unknown: Glucagon like peptide-1
VAHGILNEAYRKVLDQLSAGKHLQSLVA

SEQ ID NO: 48 - protein, 28 aa, Unknown
  Description of Unknown: Glucagon like peptide-1
VAHGILDKAYRKVLDQLSARRYLQTLMA

SEQ ID NO: 49 - protein, 28 aa, Unknown
  Description of Unknown: Glucagon like peptide-1
HADGMFNKAYRKALGQLSARKYLHSLMA

SEQ ID NO: 50 - protein, 28 aa, Unknown
  Description of Unknown: Glucagon like peptide-1
HADGSFSDEMNTVLDSLATRDFINWLLQ

SEQ ID NO: 51 - protein, 27 aa, Unknown
  Description of Unknown: Glucagon like peptide-1
HSDGTFTSELSRLRESARLQRLLQGLV

SEQ ID NO: 52 - protein, 27 aa, Unknown
  Description of Unknown: Glucagon like peptide-1
HSDGLFTSEYSKMRGNAQVQKFIQNLM

SEQ ID NO: 53 - protein, 28 aa, Unknown
  Description of Unknown: Glucagon like peptide-1
HSDGTFTSDLSKQMEEEAVRLFIEWLKN

SEQ ID NO: 54 - protein, 31 aa, Artificial Sequence
  Description of Artificial Sequence: Synthetic polypeptide
HAEGTFTSDVSSYLEGQAAREFIAWLVKGRG

SEQ ID NO: 55 - protein, 31 aa, Artificial Sequence
  Description of Artificial Sequence: Synthetic polypeptide
HAEGTFTSDVSSYLEGQAAKEFIAWLVRGRG

SEQ ID NO: 56 - protein, 31 aa, Artificial Sequence
  Description of Artificial Sequence: Synthetic polypeptide
HAEGTFTSDVSSYLEGQAAKEFIAWLVKGKG

SEQ ID NO: 57 - protein, 31 aa, Artificial Sequence
  Description of Artificial Sequence: Synthetic polypeptide
HAEGTFTSDVSSYLEGQAAREFIAWLVRGKG

SEQ ID NO: 58 - protein, 32 aa, Artificial Sequence
  Description of Artificial Sequence: Synthetic polypeptide
HAEGTFTSDVSSYLEGQAAREFIAWLVRGKGR

SEQ ID NO: 59 - protein, 33 aa, Artificial Sequence
  Description of Artificial Sequence: Synthetic polypeptide
HAEGTFTSDVSSYLEGQAAREFIAWLVRGRGRK

SEQ ID NO: 60 - protein, 34 aa, Artificial Sequence
  Description of Artificial Sequence: Synthetic polypeptide
HAEGTFTSDVSSYLEGQAAREFIAWLVRGRGRRK

SEQ ID NO: 61 - protein, 31 aa, Artificial Sequence
  Description of Artificial Sequence: Synthetic polypeptide
HAEGTFTSDVSSYLEGQAAREFIAWLVKGKG

SEQ ID NO: 62 - protein, 31 aa, Artificial Sequence
  Description of Artificial Sequence: Synthetic polypeptide
HAEGTFTSDVSSYLEGQAAKEFIAWLVRGKG

SEQ ID NO: 63 - protein, 33 aa, Artificial Sequence
  Description of Artificial Sequence: Synthetic polypeptide
HAEGTFTSDVSSYLEGQAAREFIAWLVKGRGRK

SEQ ID NO: 64 - protein, 34 aa, Artificial Sequence
  Description of Artificial Sequence: Synthetic polypeptide
HAEGTFTSDVSSYLEGQAAKEFIAWLVRGRGRRK

SEQ ID NO: 65 - protein, 33 aa, Artificial Sequence
  Description of Artificial Sequence: Synthetic polypeptide
HAEGTFTSDVSSYLEGQAAREFIAWLVRGKGRK

SEQ ID NO: 66 - protein, 34 aa, Artificial Sequence
  Description of Artificial Sequence: Synthetic polypeptide
HAEGTFTSDVSSYLEGQAAREFIAWLVRGKGRRK

SEQ ID NO: 67 - protein, 31 aa, Artificial Sequence
  Description of Artificial Sequence: Synthetic polypeptide
HGEGTFTSDVSSYLEGQAAREFIAWLVKGRG

SEQ ID NO: 68 - protein, 31 aa, Artificial Sequence
  Description of Artificial Sequence: Synthetic polypeptide
HGEGTFTSDVSSYLEGQAAKEFIAWLVRGRG

SEQ ID NO: 69 - protein, 31 aa, Artificial Sequence
  Description of Artificial Sequence: Synthetic polypeptide
HGEGTFTSDVSSYLEGQAAKEFIAWLVKGKG

SEQ ID NO: 70 - protein, 31 aa, Artificial Sequence
  Description of Artificial Sequence: Synthetic polypeptide
HGEGTFTSDVSSYLEGQAAREFIAWLVRGKG

SEQ ID NO: 71 - protein, 33 aa, Artificial Sequence
  Description of Artificial Sequence: Synthetic polypeptide
HGEGTFTSDVSSYLEGQAAREFIAWLVRGRGRK

SEQ ID NO: 72 - protein, 34 aa, Artificial Sequence
  Description of Artificial Sequence: Synthetic polypeptide
HGEGTFTSDVSSYLEGQAAREFIAWLVRGRGRRK

SEQ ID NO: 73 - protein, 31 aa, Artificial Sequence
  Description of Artificial Sequence: Synthetic polypeptide
HGEGTFTSDVSSYLEGQAAREFIAWLVKGKG

SEQ ID NO: 74 - protein, 31 aa, Artificial Sequence
  Description of Artificial Sequence: Synthetic polypeptide
HGEGTFTSDVSSYLEGQAAKEFIAWLVRGKG

SEQ ID NO: 75 - protein, 33 aa, Artificial Sequence
  Description of Artificial Sequence: Synthetic polypeptide
HGEGTFTSDVSSYLEGQAAREFIAWLVKGRGRK

SEQ ID NO: 76 - protein, 34 aa, Artificial Sequence
  Description of Artificial Sequence: Synthetic polypeptide
HGEGTFTSDVSSYLEGQAAKEFIAWLVRGRGRRK

SEQ ID NO: 77 - protein, 33 aa, Artificial Sequence
  Description of Artificial Sequence: Synthetic polypeptide
HGEGTFTSDVSSYLEGQAAREFIAWLVRGKGRK

SEQ ID NO: 78 - protein, 34 aa, Artificial Sequence
  Description of Artificial Sequence: Synthetic polypeptide
HGEGTFTSDVSSYLEGQAAREFIAWLVRGKGRRK

SEQ ID NO: 79 - protein, 32 aa, Artificial Sequence
  Description of Artificial Sequence: Synthetic polypeptide
HAEGTFTSDVSSYLEGQAAREFIAWLVRGRGK

SEQ ID NO: 80 - protein, 33 aa, Artificial Sequence; identical to SEQ ID NO: 59
  Description of Artificial Sequence: Synthetic polypeptide

SEQ ID NO: 81 - protein, 34 aa, Artificial Sequence; identical to SEQ ID NO: 60
  Description of Artificial Sequence: Synthetic polypeptide

SEQ ID NO: 82 - protein, 35 aa, Artificial Sequence
  Description of Artificial Sequence: Synthetic polypeptide
HAEGTFTSDVSSYLEGQAAREFIAWLVRGRGRREK

SEQ ID NO: 83 - protein, 36 aa, Artificial Sequence
  Description of Artificial Sequence: Synthetic polypeptide
HAEGTFTSDVSSYLEGQAAREFIAWLVRGRGRREFK

SEQ ID NO: 84 - protein, 37 aa, Artificial Sequence
  Description of Artificial Sequence: Synthetic polypeptide
HAEGTFTSDVSSYLEGQAAREFIAWLVRGRGRREFPK

SEQ ID NO: 85 - protein, 38 aa, Artificial Sequence
  Description of Artificial Sequence: Synthetic polypeptide
HAEGTFTSDVSSYLEGQAAREFIAWLVRGRGRREFPEK

SEQ ID NO: 86 - protein, 39 aa, Artificial Sequence
  Description of Artificial Sequence: Synthetic polypeptide
HAEGTFTSDVSSYLEGQAAREFIAWLVRGRGRREFPEEK

SEQ ID NO: 87 - protein, 38 aa, Artificial Sequence
  Description of Artificial Sequence: Synthetic polypeptide
HDEFERHAEGTFTSDVSSYLEGQAAREFIAWLVRGRGK

SEQ ID NO: 88 - protein, 39 aa, Artificial Sequence
  Description of Artificial Sequence: Synthetic polypeptide
HDEFERHAEGTFTSDVSSYLEGQAAREFIAWLVRGRGRK

SEQ ID NO: 89 - protein, 40 aa, Artificial Sequence
  Description of Artificial Sequence: Synthetic polypeptide
HDEFERHAEGTFTSDVSSYLEGQAAREFIAWLVRGRGRRK

SEQ ID NO: 90 - protein, 41 aa, Artificial Sequence
  Description of Artificial Sequence: Synthetic polypeptide
HDEFERHAEGTFTSDVSSYLEGQAAREFIAWLVRGRGRREK

SEQ ID NO: 91 - protein, 42 aa, Artificial Sequence
  Description of Artificial Sequence: Synthetic polypeptide
HDEFERHAEGTFTSDVSSYLEGQAAREFIAWLVRGRGRREFK

SEQ ID NO: 92 - protein, 43 aa, Artificial Sequence
  Description of Artificial Sequence: Synthetic polypeptide
HDEFERHAEGTFTSDVSSYLEGQAAREFIAWLVRGRGRREFPK

SEQ ID NO: 93 - protein, 44 aa, Artificial Sequence
  Description of Artificial Sequence: Synthetic polypeptide
HDEFERHAEGTFTSDVSSYLEGQAAREFIAWLVRGRGRREFPEK

SEQ ID NO: 94 - protein, 45 aa, Artificial Sequence
  Description of Artificial Sequence: Synthetic polypeptide
HDEFERHAEGTFTSDVSSYLEGQAAREFIAWLVRGRGRREFPEEK

SEQ ID NO: 95 - protein, 38 aa, Artificial Sequence
  Description of Artificial Sequence: Synthetic polypeptide
DEFERHAEGTFTSDVSSYLEGQAAREFIAWLVRGRGRK

SEQ ID NO: 96 - protein, 39 aa, Artificial Sequence
  Description of Artificial Sequence: Synthetic polypeptide
DEFERHAEGTFTSDVSSYLEGQAAREFIAWLVRGRGRRK

SEQ ID NO: 97 - protein, 40 aa, Artificial Sequence
  Description of Artificial Sequence: Synthetic polypeptide
DEFERHAEGTFTSDVSSYLEGQAAREFIAWLVRGRGRREK

SEQ ID NO: 98 - protein, 41 aa, Artificial Sequence
  Description of Artificial Sequence: Synthetic polypeptide
DEFERHAEGTFTSDVSSYLEGQAAREFIAWLVRGRGRREFK

SEQ ID NO: 99 - protein, 42 aa, Artificial Sequence
  Description of Artificial Sequence: Synthetic polypeptide
DEFERHAEGTFTSDVSSYLEGQAAREFIAWLVRGRGRREFPK

SEQ ID NO: 100 - protein, 43 aa, Artificial Sequence
  Description of Artificial Sequence: Synthetic polypeptide
DEFERHAEGTFTSDVSSYLEGQAAREFIAWLVRGRGRREFPEK

SEQ ID NO: 101 - protein, 44 aa, Artificial Sequence
  Description of Artificial Sequence: Synthetic polypeptide
DEFERHAEGTFTSDVSSYLEGQAAREFIAWLVRGRGRREFPEEK

SEQ ID NO: 102 - protein, 36 aa, Artificial Sequence
  Description of Artificial Sequence: Synthetic polypeptide
EFERHAEGTFTSDVSSYLEGQAAREFIAWLVRGRGK

SEQ ID NO: 103 - protein, 37 aa, Artificial Sequence
  Description of Artificial Sequence: Synthetic polypeptide
EFERHAEGTFTSDVSSYLEGQAAREFIAWLVRGRGRK

SEQ ID NO: 104 - protein, 38 aa, Artificial Sequence
  Description of Artificial Sequence: Synthetic polypeptide
EFERHAEGTFTSDVSSYLEGQAAREFIAWLVRGRGRRK

SEQ ID NO: 105 - protein, 39 aa, Artificial Sequence
  Description of Artificial Sequence: Synthetic polypeptide
EFERHAEGTFTSDVSSYLEGQAAREFIAWLVRGRGRREK

SEQ ID NO: 106 - protein, 40 aa, Artificial Sequence
  Description of Artificial Sequence: Synthetic polypeptide
EFERHAEGTFTSDVSSYLEGQAAREFIAWLVRGRGRREFK

SEQ ID NO: 107 - protein, 41 aa, Artificial Sequence
  Description of Artificial Sequence: Synthetic polypeptide
EFERHAEGTFTSDVSSYLEGQAAREFIAWLVRGRGRREFPK

SEQ ID NO: 108 - protein, 42 aa, Artificial Sequence
  Description of Artificial Sequence: Synthetic polypeptide
EFERHAEGTFTSDVSSYLEGQAAREFIAWLVRGRGRREFPEK

SEQ ID NO: 109 - protein, 43 aa, Artificial Sequence
  Description of Artificial Sequence: Synthetic polypeptide
EFERHAEGTFTSDVSSYLEGQAAREFIAWLVRGRGRREFPEEK

SEQ ID NO: 110 - protein, 35 aa, Artificial Sequence
  Description of Artificial Sequence: Synthetic polypeptide
FERHAEGTFTSDVSSYLEGQAAREFIAWLVRGRGK

SEQ ID NO: 111 - protein, 36 aa, Artificial Sequence
  Description of Artificial Sequence: Synthetic polypeptide
FERHAEGTFTSDVSSYLEGQAAREFIAWLVRGRGRK

SEQ ID NO: 112 - protein, 37 aa, Artificial Sequence
  Description of Artificial Sequence: Synthetic polypeptide
FERHAEGTFTSDVSSYLEGQAAREFIAWLVRGRGRRK

SEQ ID NO: 113 - protein, 38 aa, Artificial Sequence
  Description of Artificial Sequence: Synthetic polypeptide
FERHAEGTFTSDVSSYLEGQAAREFIAWLVRGRGRREK

SEQ ID NO: 114 - protein, 39 aa, Artificial Sequence
  Description of Artificial Sequence: Synthetic polypeptide
FERHAEGTFTSDVSSYLEGQAAREFIAWLVRGRGRREFK

SEQ ID NO: 115 - protein, 40 aa, Artificial Sequence
  Description of Artificial Sequence: Synthetic polypeptide
FERHAEGTFTSDVSSYLEGQAAREFIAWLVRGRGRREFPK

SEQ ID NO: 116 - protein, 41 aa, Artificial Sequence
  Description of Artificial Sequence: Synthetic polypeptide
FERHAEGTFTSDVSSYLEGQAAREFIAWLVRGRGRREFPEK

SEQ ID NO: 117 - protein, 42 aa, Artificial Sequence
  Description of Artificial Sequence: Synthetic polypeptide
FERHAEGTFTSDVSSYLEGQAAREFIAWLVRGRGRREFPEEK

SEQ ID NO: 118 - protein, 34 aa, Artificial Sequence
  Description of Artificial Sequence: Synthetic polypeptide
ERHAEGTFTSDVSSYLEGQAAREFIAWLVRGRGK

SEQ ID NO: 119 - protein, 35 aa, Artificial Sequence
  Description of Artificial Sequence: Synthetic polypeptide
ERHAEGTFTSDVSSYLEGQAAREFIAWLVRGRGRK

SEQ ID NO: 120 - protein, 36 aa, Artificial Sequence
  Description of Artificial Sequence: Synthetic polypeptide
ERHAEGTFTSDVSSYLEGQAAREFIAWLVRGRGRRK

SEQ ID NO: 121 - protein, 37 aa, Artificial Sequence
  Description of Artificial Sequence: Synthetic polypeptide
ERHAEGTFTSDVSSYLEGQAAREFIAWLVRGRGRREK

SEQ ID NO: 122 - protein, 38 aa, Artificial Sequence
  Description of Artificial Sequence: Synthetic polypeptide
ERHAEGTFTSDVSSYLEGQAAREFIAWLVRGRGRREFK

SEQ ID NO: 123 - protein, 39 aa, Artificial Sequence
  Description of Artificial Sequence: Synthetic polypeptide
ERHAEGTFTSDVSSYLEGQAAREFIAWLVRGRGRREFPK

SEQ ID NO: 124 - protein, 40 aa, Artificial Sequence
  Description of Artificial Sequence: Synthetic polypeptide
ERHAEGTFTSDVSSYLEGQAAREFIAWLVRGRGRREFPEK

SEQ ID NO: 125 - protein, 41 aa, Artificial Sequence
  Description of Artificial Sequence: Synthetic polypeptide
ERHAEGTFTSDVSSYLEGQAAREFIAWLVRGRGRREFPEEK

SEQ ID NO: 126 - protein, 33 aa, Artificial Sequence
  Description of Artificial Sequence: Synthetic polypeptide
RHAEGTFTSDVSSYLEGQAAREFIAWLVRGRGK

SEQ ID NO: 127 - protein, 34 aa, Artificial Sequence
  Description of Artificial Sequence: Synthetic polypeptide
RHAEGTFTSDVSSYLEGQAAREFIAWLVRGRGRK

SEQ ID NO: 128 - protein, 35 aa, Artificial Sequence
  Description of Artificial Sequence: Synthetic polypeptide
RHAEGTFTSDVSSYLEGQAAREFIAWLVRGRGRRK

SEQ ID NO: 129 - protein, 36 aa, Artificial Sequence
  Description of Artificial Sequence: Synthetic polypeptide
RHAEGTFTSDVSSYLEGQAAREFIAWLVRGRGRREK

SEQ ID NO: 130 - protein, 37 aa, Artificial Sequence
  Description of Artificial Sequence: Synthetic polypeptide
RHAEGTFTSDVSSYLEGQAAREFIAWLVRGRGRREFK

SEQ ID NO: 131 - protein, 38 aa, Artificial Sequence
  Description of Artificial Sequence: Synthetic polypeptide
RHAEGTFTSDVSSYLEGQAAREFIAWLVRGRGRREFPK

SEQ ID NO: 132 - protein, 39 aa, Artificial Sequence
  Description of Artificial Sequence: Synthetic polypeptide
RHAEGTFTSDVSSYLEGQAAREFIAWLVRGRGRREFPEK

SEQ ID NO: 133 - protein, 40 aa, Artificial Sequence
  Description of Artificial Sequence: Synthetic polypeptide
RHAEGTFTSDVSSYLEGQAAREFIAWLVRGRGRREFPEEK

SEQ ID NO: 134 - protein, 38 aa, Artificial Sequence
  Description of Artificial Sequence: Synthetic polypeptide
HDEFERHAEGTFTSDVSSYLEGQAAREFIAWLVKGRGK

SEQ ID NO: 135 - protein, 38 aa, Artificial Sequence
  Description of Artificial Sequence: Synthetic polypeptide
HDEFERHAEGTFTSDVSSYLEGQAAKEFIAWLVRGRGK

SEQ ID NO: 136 - protein, 38 aa, Artificial Sequence
  Description of Artificial Sequence: Synthetic polypeptide
HDEFERHAEGTFTSDVSSYLEGQAAREFIAWLVRGKGK

SEQ ID NO: 137 - protein, 32 aa, Artificial Sequence
  Description of Artificial Sequence: Synthetic polypeptide
HAEGTFTSDVSSYLEGQAAREFIAWLVKGRGK

SEQ ID NO: 138 - protein, 32 aa, Artificial Sequence
  Description of Artificial Sequence: Synthetic polypeptide
HAEGTFTSDVSSYLEGQAAKEFIAWLVRGRGK

SEQ ID NO: 139 - protein, 32 aa, Artificial Sequence
  Description of Artificial Sequence: Synthetic polypeptide
HAEGTFTSDVSSYLEGQAAREFIAWLVRGKGK

SEQ ID NO: 140 - protein, 32 aa, Artificial Sequence; identical to SEQ ID NO: 79
  Description of Artificial Sequence: Synthetic polypeptide

SEQ ID NO: 141 - protein, 39 aa, Artificial Sequence
  Description of Artificial Sequence: Synthetic polypeptide
HDEFERHAEGTFTSDVSSYLEGQAAREFIAWLVKGRGRK

SEQ ID NO: 142 - protein, 39 aa, Artificial Sequence
  Description of Artificial Sequence: Synthetic polypeptide
HDEFERHAEGTFTSDVSSYLEGQAAKEFIAWLVRGRGRK

SEQ ID NO: 143 - protein, 39 aa, Artificial Sequence
  Description of Artificial Sequence: Synthetic polypeptide
HDEFERHAEGTFTSDVSSYLEGQAAREFIAWLVRGKGRK

SEQ ID NO: 144 - protein, 33 aa, Artificial Sequence; identical to SEQ ID NO: 63
  Description of Artificial Sequence: Synthetic polypeptide

SEQ ID NO: 145 - protein, 33 aa, Artificial Sequence
  Description of Artificial Sequence: Synthetic polypeptide
HAEGTFTSDVSSYLEGQAAKEFIAWLVRGRGRK

SEQ ID NO: 146 - protein, 33 aa, Artificial Sequence; identical to SEQ ID NO: 65
  Description of Artificial Sequence: Synthetic polypeptide

SEQ ID NO: 147 - protein, 32 aa, Artificial Sequence
  Description of Artificial Sequence: Synthetic polypeptide
HGEGTFTSDVSSYLEGQAAREFIAWLVKGRGK

SEQ ID NO: 148 - protein, 32 aa, Artificial Sequence
  Description of Artificial Sequence: Synthetic polypeptide
HGEGTFTSDVSSYLEGQAAREFIAWLVRGKGK

SEQ ID NO: 149 - protein, 37 aa, Artificial Sequence; identical to SEQ ID NO: 12
  Description of Artificial Sequence: Synthetic polypeptide

SEQ ID NO: 150 - protein, 37 aa, Artificial Sequence
  Description of Artificial Sequence: Synthetic polypeptide
KCNTATCATNRLANFLVHSSNNFGGILPPTNVGSNTY

SEQ ID NO: 151 - protein, 37 aa, Artificial Sequence
  Description of Artificial Sequence: Synthetic polypeptide
KCNTATCATNRLANFLVHSSNNFGPILGPTNVGSNTY

SEQ ID NO: 152 - protein, 37 aa, Artificial Sequence
  Description of Artificial Sequence: Synthetic polypeptide
KCNTATCATNRLANFLVHSSNNFGPILPGTNVGSNTY

SEQ ID NO: 153 - protein, 37 aa, Artificial Sequence
  Description of Artificial Sequence: Synthetic polypeptide
KCNTATCATNRLANFLVHSSNNFGGILGPTNVGSNTY

SEQ ID NO: 154 - protein, 37 aa, Artificial Sequence
  Description of Artificial Sequence: Synthetic polypeptide
KCNTATCATNRLANFLVHSSNNFGPILGGTNVGSNTY

SEQ ID NO: 155 - protein, 37 aa, Artificial Sequence
  Description of Artificial Sequence: Synthetic polypeptide
KCNTATCATNRLANFLVHSSNNFGGILPGTNVGSNTY

SEQ ID NO: 156 - protein, 37 aa, Artificial Sequence; identical to SEQ ID NO: 14
  Description of Artificial Sequence: Synthetic polypeptide

SEQ ID NO: 157 - protein, 12 aa, Artificial Sequence
  Description of Artificial Sequence: Synthetic peptide
GESPGGSSGSES

SEQ ID NO: 158 - protein, 12 aa, Artificial Sequence
  Description of Artificial Sequence: Synthetic peptide
GSEGSSGPGESS

SEQ ID NO: 159 - protein, 12 aa, Artificial Sequence
  Description of Artificial Sequence: Synthetic peptide
GSSESGSSEGGP

SEQ ID NO: 160 - protein, 12 aa, Artificial Sequence
  Description of Artificial Sequence: Synthetic peptide
GSGGEPSESGSS

SEQ ID NO: 161 - protein, 12 aa, Artificial Sequence
  Description of Artificial Sequence: Synthetic peptide
GSPAGSPTSTEE

SEQ ID NO: 162 - protein, 12 aa, Artificial Sequence
  Description of Artificial Sequence: Synthetic peptide
GSEPATSGSETP

SEQ ID NO: 163 - protein, 12 aa, Artificial Sequence
  Description of Artificial Sequence: Synthetic peptide
GTSESATPESGP

SEQ ID NO: 164 - protein, 12 aa, Artificial Sequence
  Description of Artificial Sequence: Synthetic peptide
GTSTEPSEGSAP

SEQ ID NO: 165 - protein, 12 aa, Artificial Sequence
  Description of Artificial Sequence: Synthetic peptide
GSTSESPSGTAP

SEQ ID NO: 166 - protein, 12 aa, Artificial Sequence
  Description of Artificial Sequence: Synthetic peptide
GTSTPESGSASP

SEQ ID NO: 167 - protein, 12 aa, Artificial Sequence
  Description of Artificial Sequence: Synthetic peptide
GTSPSGESSTAP

SEQ ID NO: 168 - protein, 12 aa, Artificial Sequence
  Description of Artificial Sequence: Synthetic peptide
GSTSSTAESPGP

SEQ ID NO: 169 - protein, 12 aa, Artificial Sequence
  Description of Artificial Sequence: Synthetic peptide
GTPGSGTASSSP

SEQ ID NO: 170 - protein, 12 aa, Artificial Sequence
  Description of Artificial Sequence: Synthetic peptide
GSSTPSGATGSP

SEQ ID NO: 171 - protein, 12 aa, Artificial Sequence
  Description of Artificial Sequence: Synthetic peptide
GSSPSASTGTGP

SEQ ID NO: 172 - protein, 12 aa, Artificial Sequence
  Description of Artificial Sequence: Synthetic peptide
GASPGTSSTGSP

SEQ ID NO: 173 - protein, 12 aa, Artificial Sequence
  Description of Artificial Sequence: Synthetic peptide
GEPAGSPTSTSE

SEQ ID NO: 174 - protein, 12 aa, Artificial Sequence
  Description of Artificial Sequence: Synthetic peptide
GTGEPSSTPASE

SEQ ID NO: 175 - protein, 12 aa, Artificial Sequence
  Description of Artificial Sequence: Synthetic peptide
GSGPSTESAPTE

SEQ ID NO: 176 - protein, 12 aa, Artificial Sequence
  Description of Artificial Sequence: Synthetic peptide
GSETPSGPSETA

SEQ ID NO: 177 - protein, 12 aa, Artificial Sequence
  Description of Artificial Sequence: Synthetic peptide
GPSETSTSEPGA

SEQ ID NO: 178 - protein, 12 aa, Artificial Sequence
  Description of Artificial Sequence: Synthetic peptide
GSPSEPTEGTSA

SEQ ID NO: 179 - protein, 12 aa, Artificial Sequence
  Description of Artificial Sequence: Synthetic peptide
GSGASEPTSTEP

SEQ ID NO: 180 - protein, 12 aa, Artificial Sequence
  Description of Artificial Sequence: Synthetic peptide
GSEPATSGTEPS

SEQ ID NO: 181 - protein, 12 aa, Artificial Sequence
  Description of Artificial Sequence: Synthetic peptide
GTSEPSTSEPGA

SEQ ID NO: 182 - protein, 12 aa, Artificial Sequence
  Description of Artificial Sequence: Synthetic peptide
GTSTEPSEPGSA

SEQ ID NO: 183 - protein, 12 aa, Artificial Sequence
  Description of Artificial Sequence: Synthetic peptide
GSTAGSETSTEA

SEQ ID NO: 184 - protein, 12 aa, Artificial Sequence
  Description of Artificial Sequence: Synthetic peptide
GSETATSGSETA

SEQ ID NO: 185 - protein, 12 aa, Artificial Sequence
  Description of Artificial Sequence: Synthetic peptide
GTSESATSESGA

SEQ ID NO: 186 - protein, 12 aa, Artificial Sequence
  Description of Artificial Sequence: Synthetic peptide
GTSTEASEGSAS

SEQ ID NO: 187 - protein, 48 aa, Artificial Sequence
  Description of Artificial Sequence: Synthetic polypeptide
MAEPAGSPTSTEEGTPGSGTASSSPGSSTPSGATGSPGASPGTSSTGS

SEQ ID NO: 188 - protein, 48 aa, Artificial Sequence
  Description of Artificial Sequence: Synthetic polypeptide
MAEPAGSPTSTEEGASPGTSSTGSPGSSTPSGATGSPGSSTPSGATGS

SEQ ID NO: 189 - protein, 144 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 190 - protein, 144 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 191 - protein, 288 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 192 - protein, 504 aa, Artificial Sequence
  Description of Artificial Sequence: Synthetic polypeptide
  MOD_RES (63)..(63): Any amino acid
  MOD_RES (207)..(207): Any amino acid
GASPGTSSTGSPGSSPSASTGTGPGSSPSASTGTGPGTPGSGTASSSPGSSTPSGATGSPGSXPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSXPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 193 - protein, 540 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 194 - protein, 576 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 195 - protein, 576 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 196 - protein, 576 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 197 - protein, 625 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 198 - protein, 836 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 199 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 200 - protein, 875 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 201 - protein, 864 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 202 - protein, 875 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 203 - protein, 913 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 204 - protein, 924 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 205 - protein, 1318 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 206 - protein, 864 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 207 - protein, 864 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 208 - protein, 48 aa, Artificial Sequence; identical to SEQ ID NO: 187
  Description of Artificial Sequence: Synthetic polypeptide

SEQ ID NO: 209 - protein, 48 aa, Artificial Sequence; identical to SEQ ID NO: 188
  Description of Artificial Sequence: Synthetic polypeptide

SEQ ID NO: 210 - protein, 8 aa, Artificial Sequence
  Description of Artificial Sequence: Synthetic peptide
LTPRSLLV

SEQ ID NO: 211 - protein, 8 aa, Artificial Sequence
  Description of Artificial Sequence: Synthetic peptide
LTPRSLLV

SEQ ID NO: 212 - protein, 8 aa, Unknown
  Description of Unknown: FXIa cleavage sequence
KLTRVVGG

SEQ ID NO: 213 - protein, 8 aa, Unknown
  Description of Unknown: FXIIa cleavage sequence
TMTRIVGG

SEQ ID NO: 214 - protein, 8 aa, Unknown
  Description of Unknown: Kallikrein cleavage sequence
SPFRSTGG

SEQ ID NO: 215 - protein, 8 aa, Unknown
  Description of Unknown: FVIIa cleavage sequence
LQVRIVGG

SEQ ID NO: 216 - protein, 8 aa, Unknown
  Description of Unknown: FIXa cleavage sequence
PLGRIVGG

SEQ ID NO: 217 - protein, 8 aa, Unknown
  Description of Unknown: FXa cleavage sequence
IEGRTVGG

SEQ ID NO: 218 - protein, 8 aa, Unknown
  Description of Unknown: FIIa (thrombin) cleavage sequence
LTPRSLLV

SEQ ID NO: 219 - protein, 8 aa, Unknown
  Description of Unknown: Elastase-2 cleavage sequence
LGPVSGVP

SEQ ID NO: 220 - protein, 8 aa, Unknown
  Description of Unknown: Granzyme-B cleavage sequence
VAGDSLEE

SEQ ID NO: 221 - protein, 8 aa, Unknown
  Description of Unknown: MMP-12 cleavage sequence
GPAGLGGA

SEQ ID NO: 222 - protein, 8 aa, Unknown
  Description of Unknown: MMP-12 minimal cut site
  MOD_RES (2)..(2): Pro or Ala
  MOD_RES (3)..(3): Any amino acid
  MOD_RES (6)..(6): Any amino acid
  MOD_RES (8)..(8): Any amino acid
GXXGLXGX

SEQ ID NO: 223 - protein, 8 aa, Unknown
  Description of Unknown: MMP-13 cleavage sequence
GPAGLRGA

SEQ ID NO: 224 - protein, 8 aa, Unknown
  Description of Unknown: MMP-13 minimal cut site
  MOD_RES (3)..(3): Any amino acid
  MOD_RES (6)..(6): Any amino acid
  MOD_RES (7)..(7): Gly or Ala
  MOD_RES (8)..(8): Any amino acid
GPXGLXXX

SEQ ID NO: 225 - protein, 8 aa, Unknown
  Description of Unknown: MMP-17 cleavage sequence
APLGLRLR

SEQ ID NO: 226 - protein, 8 aa, Unknown
  Description of Unknown: MMP-20 cleavage sequence
PALPLVAQ

SEQ ID NO: 227 - protein, 7 aa, Unknown
  Description of Unknown: TEV cleavage sequence
ENLYFQG

SEQ ID NO: 228 - protein, 8 aa, Unknown
  Description of Unknown: TEV minimal cut site
ENLYFQGS

SEQ ID NO: 229 - protein, 8 aa, Unknown
  Description of Unknown: Enterokinase cleavage sequence
DDDKIVGG

SEQ ID NO: 230 - protein, 8 aa, Unknown
  Description of Unknown: Enterokinase minimal cut site
DDDKIVGG

SEQ ID NO: 231 - protein, 8 aa, Unknown
  Description of Unknown: Protease 3C (PreScissionTM) cleavage sequence
LEVLFQGP

SEQ ID NO: 232 - protein, 8 aa, Unknown
  Description of Unknown: Protease 3C (PreScissionTM) minimal cut site
LEVLFQGP

SEQ ID NO: 233 - protein, 8 aa, Unknown
  Description of Unknown: Sortase A cleavage sequence
LPKTGSES

SEQ ID NO: 234 - protein, 8 aa, Unknown
  Description of Unknown: Sortase A minimal cut site
  MOD_RES (3)..(3): Lys, Glu, Ala, or Asp
  MOD_RES (6)..(6): Any amino acid
  MOD_RES (7)..(7): Glu, Lys, or Ser
LPXTGXXS

SEQ ID NO: 235 - DNA, 144 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttct

SEQ ID NO: 236 - DNA, 144 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctct

SEQ ID NO: 237 - DNA, 432 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 238 - DNA, 432 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcacca

SEQ ID NO: 239 - DNA, 864 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 240 - DNA, 1728 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 241 - DNA, 1728 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctcca

SEQ ID NO: 242 - DNA, 2625 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 243 - DNA, 2592 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 244 - DNA, 2625 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 245 - DNA, 2592 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 246 - DNA, 2772 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 247 - DNA, 2739 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 248 - DNA, 3954 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 249 - DNA, 2592 bp, Artificial Sequence
  Description of Artificial Sequence: Synthetic polynucleotide
ggtacttccaccgaaccatccgaaccaggtagcgcaggtacttccaccgaaccatccgaacctggcagcgcaggtagcgaaccggcaacctctggtactgaaccatcaggtagcggcgcatccgagcctacctctactgaaccaggtagcgaaccggctacctccggtactgagccatcaggtagcgaaccggcaacttccggtactgaaccatcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtagcgaaccggctacctctggtactgaaccatcaggtacttctaccgaaccatccgagcctggtagcgcaggtacttctaccgaaccatccgagccaggcagcgcaggtagcgaaccggcaacctctggcactgagccatcaggtagcgaaccagcaacttctggtactgaaccatcaggtactagcgagccatctacttccgaaccaggtgcaggtagcggcgcatccgaacctacttccactgaaccaggtactagcgagccatccacctctgaaccaggtgcaggtagcgaaccggcaacttccggcactgaaccatcaggtagcgaaccggctacctctggtactgaaccatcaggtacttctaccgaaccatccgagcctggtagcgcaggtacttctaccgaaccatccgagccaggcagcgcaggtagcggtgcatccgagccgacctctactgaaccaggtagcgaaccagcaacttctggcactgagccatcaggtagcgaaccagctacctctggtactgaaccatcaggtagcgaaccggctacttccggcactgaaccatcaggtagcgaaccagcaacctccggtactgaaccatcaggtacttccactgaaccatccgaaccgggtagcgcaggtagcgaaccggcaacttccggcactgaaccatcaggtagcggtgcatctgagccgacctctactgaaccaggtacttctactgaaccatctgagccgggcagcgcaggtagcgaacctgcaacctccggcactgagccatcaggtagcggcgcatctgaaccaacctctactgaaccaggtacttccaccgaaccatctgagccaggcagcgcaggtagcggcgcatctgaaccaacctctactgaaccaggtagcgaaccagcaacttctggtactgaaccatcaggtagcggcgcatctgagcctacttccactgaaccaggtagcgaaccggcaacttccggcactgaaccatcaggtagcggtgcatctgagccgacctctactgaaccaggtacttctactgaaccatctgagccgggcagcgcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtacttctactgaaccatccgagccgggtagcgcaggtacttccactgaaccatctgaacctggtagcgcaggtacttccactgaaccatccgaaccaggtagcgcaggtacttctactgaaccatccgagccgggtagcgcaggtacttccactgaaccatctgaacctggtagcgcaggtacttccactgaaccatccgaaccaggtagcgcaggtactagcgaaccatccacctccgaaccaggcgcaggtagcggtgcatctgaaccgacttctactgaaccaggtacttccactgaaccatctgagccaggtagcgcaggtacttccaccgaaccatccgaaccaggtagcgcaggtacttccaccgaaccatccgaacctggcagcgcaggtagcgaaccggcaacctctggtactgaaccatcaggtagcggtgcatccgagccgacctctactgaaccaggtagcgaaccagcaacttctggcactgagccatcaggtagcgaaccagctacctctggtactgaaccatcaggtagcgaaccggcaacctctggcactgagccatcaggtagcgaaccagcaacttctggtactgaaccatcaggtactagcgagccatctacttccgaaccaggtgcaggtagcgaacctgcaacctccggcactgagccatcaggtagcggcgcatctgaaccaacctctactgaaccaggtacttccaccgaaccatctgagccaggcagcgcaggtagcgaacctgcaacctccggcactgagccatcaggtagcggcgcatctgaaccaacctctactgaaccaggtacttccaccgaaccatctgagccaggcagcgca

SEQ ID NO: 250 - DNA, 2592 bp, Artificial Sequence
  Description of Artificial Sequence: Synthetic polynucleotide
ggtagcgaaactgctacttccggctctgagactgcaggtactagtgaatccgcaactagcgaatctggcgcaggtagcactgcaggctctgagacttccactgaagcaggtactagcgagtccgcaaccagcgaatccggcgcaggtagcgaaactgctacctctggctccgagactgcaggtagcgaaactgcaacctctggctctgaaactgcaggtacttccactgaagcaagtgaaggctccgcatcaggtacttccaccgaagcaagcgaaggctccgcatcaggtactagtgagtccgcaactagcgaatccggtgcaggtagcgaaaccgctacctctggttccgaaactgcaggtacttctaccgaggctagcgaaggttctgcatcaggtagcactgctggttccgagacttctactgaagcaggtactagcgaatctgctactagcgaatccggcgcaggtactagcgaatccgctaccagcgaatccggcgcaggtagcgaaactgcaacctctggttccgagactgcaggtactagcgagtccgctactagcgaatctggcgcaggtacttccactgaagctagtgaaggttctgcatcaggtagcgaaactgctacttctggttccgaaactgcaggtagcgaaaccgctacctctggttccgaaactgcaggtacttctaccgaggctagcgaaggttctgcatcaggtagcactgctggttccgagacttctactgaagcaggtactagcgagtccgctactagcgaatctggcgcaggtacttccactgaagctagtgaaggttctgcatcaggtagcgaaactgctacttctggttccgaaactgcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtactagcgaatctgctactagcgaatccggcgcaggtactagcgaatccgctaccagcgaatccggcgcaggtagcgaaactgcaacctctggttccgagactgcaggtagcgaaaccgctacctctggttccgaaactgcaggtacttctaccgaggctagcgaaggttctgcatcaggtagcactgctggttccgagacttctactgaagcaggtagcgaaactgctacttccggctctgagactgcaggtactagtgaatccgcaactagcgaatctggcgcaggtagcactgcaggctctgagacttccactgaagcaggtagcactgctggttccgaaacctctaccgaagcaggtagcactgcaggttctgaaacctccactgaagcaggtacttccactgaggctagtgaaggctctgcatcaggtagcactgctggttccgaaacctctaccgaagcaggtagcactgcaggttctgaaacctccactgaagcaggtacttccactgaggctagtgaaggctctgcatcaggtagcactgcaggttctgagacttccaccgaagcaggtagcgaaactgctacttctggttccgaaactgcaggtacttccactgaagctagtgaaggttccgcatcaggtactagtgagtccgcaaccagcgaatccggcgcaggtagcgaaaccgcaacctccggttctgaaactgcaggtactagcgaatccgcaaccagcgaatctggcgcaggtactagtgagtccgcaaccagcgaatccggcgcaggtagcgaaaccgcaacctccggttctgaaactgcaggtactagcgaatccgcaaccagcgaatctggcgcaggtagcgaaactgctacttccggctctgagactgcaggtacttccaccgaagcaagcgaaggttccgcatcaggtacttccaccgaggctagtgaaggctctgcatcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtagcgaaactgctacttccggctccgagactgcaggtagcgaaactgctacttctggctccgaaactgcaggtacttctactgaggctagtgaaggttccgcatcaggtactagcgagtccgcaaccagcgaatccggcgcaggtagcgaaactgctacctctggctccgagactgcaggtagcgaaactgcaacctctggctctgaaactgcaggtactagcgaatctgctactagcgaatccggcgcaggtactagcgaatccgctaccagcgaatccggcgcaggtagcgaaactgcaacctctggttccgagactgca

SEQ ID NO: 251 - DNA, 37 bp, Artificial Sequence
  Description of Artificial Sequence: Synthetic oligonucleotide
aggtgcaagcgcaagcggcgcgccaagcacgggaggt

SEQ ID NO: 252 - DNA, 37 bp, Artificial Sequence
  Description of Artificial Sequence: Synthetic oligonucleotide
aggtccagaaccaacggggccggccccaagcggaggt

SEQ ID NO: 253 - protein, 6 aa, Artificial Sequence
  Description of Artificial Sequence: Synthetic 6xHis tag
HHHHHH

SEQ ID NO: 254 - protein, 4 aa, Artificial Sequence
  Description of Artificial Sequence: Synthetic peptide
DDDK

SEQ ID NO: 255 - protein, 4 aa, Artificial Sequence
  Description of Artificial Sequence: Synthetic peptide
IDGR

SEQ ID NO: 256 - protein, 6 aa, Artificial Sequence
  Description of Artificial Sequence: Synthetic peptide
LVPRGS

SEQ ID NO: 257 - protein, 8 aa, Artificial Sequence
  Description of Artificial Sequence: Synthetic peptide
LEVLFQGP

SEQ ID NO: 258 - protein, 7 aa, Artificial Sequence
  Description of Artificial Sequence: Synthetic peptide
EQLYFQG

SEQ ID NO: 259 - protein, 7 aa, Artificial Sequence
  Description of Artificial Sequence: Synthetic peptide
ETLFQGP

SEQ ID NO: 260 - protein, 5 aa, Artificial Sequence
  Description of Artificial Sequence: Synthetic peptide
LPETG

SEQ ID NO: 261 - DNA, 147 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctcca

SEQ ID NO: 262 - DNA, 147 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctcca

SEQ ID NO: 263 - protein, 12 aa, Artificial Sequence
  Description of Artificial Sequence: Synthetic peptide
GESPGGSSGSES

SEQ ID NO: 264 - protein, 12 aa, Artificial Sequence
  Description of Artificial Sequence: Synthetic peptide
GSEGSSGPGESS

SEQ ID NO: 265 - protein, 12 aa, Artificial Sequence
  Description of Artificial Sequence: Synthetic peptide
GSSESGSSEGGP

SEQ ID NO: 266 - protein, 12 aa, Artificial Sequence
  Description of Artificial Sequence: Synthetic peptide
GSGGEPSESGSS

SEQ ID NO: 267 - DNA, 36 bp, Artificial Sequence
  Description of Artificial Sequence: Synthetic oligonucleotide
aggtgaatctccdggtggytcyagcggttcygartc

SEQ ID NO: 268 - DNA, 36 bp, Artificial Sequence
  Description of Artificial Sequence: Synthetic oligonucleotide
acctgaytcrgaaccgctrgarccacchggagattc

SEQ ID NO: 269 - DNA, 36 bp, Artificial Sequence
  Description of Artificial Sequence: Synthetic oligonucleotide
aggtagcgaaggttcttcyggtccdggygartcytc

SEQ ID NO: 270 - DNA, 36 bp, Artificial Sequence
  Description of Artificial Sequence: Synthetic oligonucleotide
acctgargaytcrcchggaccrgaagaaccttcgct

SEQ ID NO: 271 - DNA, 36 bp, Artificial Sequence
  Description of Artificial Sequence: Synthetic oligonucleotide
aggttcytcygaaagcggttcttcygarggyggtcc

SEQ ID NO: 272 - DNA, 36 bp, Artificial Sequence
  Description of Artificial Sequence: Synthetic oligonucleotide
acctggaccrccytcrgaagaaccgctttcrgarga

SEQ ID NO: 273 - DNA, 36 bp, Artificial Sequence
  Description of Artificial Sequence: Synthetic oligonucleotide
aggttcyggtggygaaccdtcygartctggtagctc

SEQ ID NO: 274 - DNA, 24 bp, Artificial Sequence
  Description of Artificial Sequence: Synthetic oligonucleotide
aggttcgtcttcactcgagggtac

SEQ ID NO: 275 - DNA, 16 bp, Artificial Sequence
  Description of Artificial Sequence: Synthetic oligonucleotide
cctcgagtgaagacga

SEQ ID NO: 276 - protein, 36 aa, Artificial Sequence
  Description of Artificial Sequence: Synthetic polypeptide
GSGGEPSESGSSGESPGGSSGSESGESPGGSSGSES

SEQ ID NO: 277 - DNA, 108 bp, Artificial Sequence
  Description of Artificial Sequence: Synthetic polynucleotide
ggttctggtggcgaaccgtccgagtctggtagctcaggtgaatctccgggtggctctagcggttccgagtcaggtgaatctcctggtggttccagcggttccgagtca

SEQ ID NO: 278 - protein, 36 aa, Artificial Sequence
  Description of Artificial Sequence: Synthetic polypeptide
GSEGSSGPGESSGESPGGSSGSESGSSESGSSEGGP

SEQ ID NO: 279 - DNA, 108 bp, Artificial Sequence
  Description of Artificial Sequence: Synthetic polynucleotide
ggtagcgaaggttcttctggtcctggcgagtcttcaggtgaatctcctggtggttccagcggttctgaatcaggttcctccgaaagcggttcttccgagggcggtcca

SEQ ID NO: 280 - protein, 36 aa, Artificial Sequence
  Description of Artificial Sequence: Synthetic polypeptide
GSSESGSSEGGPGSSESGSSEGGPGESPGGSSGSES

SEQ ID NO: 281 - DNA, 108 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtca

SEQ ID NO: 282 - protein, 36 aa, Artificial Sequence
  Description of Artificial Sequence: Synthetic polypeptide
GSGGEPSESGSSGSSESGSSEGGPGSGGEPSESGSS

SEQ ID NO: 283 - DNA, 108 bp, Artificial Sequence
  Description of Artificial Sequence: Synthetic polynucleotide
ggttccggtggcgaaccgtctgaatctggtagctcaggttcttctgaaagcggttcttccgagggtggtccaggttctggtggtgaaccttccgagtctggtagctca

SEQ ID NO: 284 - protein, 36 aa, Artificial Sequence
  Description of Artificial Sequence: Synthetic polypeptide
GSSESGSSEGGPGSEGSSGPGESSGSEGSSGPGESS

SEQ ID NO: 285 - DNA, 108 bp, Artificial Sequence
  Description of Artificial Sequence: Synthetic polynucleotide
ggttcttccgaaagcggttcttctgagggtggtccaggtagcgaaggttcttccggtccaggtgagtcttcaggtagcgaaggttcttctggtcctggtgaatcttca

SEQ ID NO: 286 - protein, 36 aa, Artificial Sequence
  Description of Artificial Sequence: Synthetic polypeptide
GSSESGSSEGGPGESPGGSSGSESGSEGSSGPGESS

SEQ ID NO: 287 - DNA, 108 bp, Artificial Sequence
  Description of Artificial Sequence: Synthetic polynucleotide
ggttcctctgaaagcggttcttccgagggtggtccaggtgaatctccaggtggttccagcggttctgagtcaggtagcgaaggttcttctggtccaggtgaatcctca

SEQ ID NO: 288 - protein, 36 aa, Artificial Sequence
  Description of Artificial Sequence: Synthetic polypeptide
GSGGEPSESGSSGSGGEPSESGSSGSEGSSGPGESS

SEQ ID NO: 289 - DNA, 108 bp, Artificial Sequence
  Description of Artificial Sequence: Synthetic polynucleotide
ggttctggtggtgaaccgtctgagtctggtagctcaggttccggtggcgaaccatccgaatctggtagctcaggtagcgaaggttcttccggtccaggtgagtcttca

SEQ ID NO: 290 - protein, 36 aa, Artificial Sequence
  Description of Artificial Sequence: Synthetic polypeptide
GSSESGSSEGGPGSEGSSGPGESSGESPGGSSGSES

SEQ ID NO: 291 - DNA, 108 bp, Artificial Sequence
  Description of Artificial Sequence: Synthetic polynucleotide
ggttcttccgaaagcggttcttccgaaggcggtccaggtagcgaaggttcttctggtccaggcgaatcttcaggtgaatctcctggtggctccagcggttctgagtca

SEQ ID NO: 292 - protein, 36 aa, Artificial Sequence
  Description of Artificial Sequence: Synthetic polypeptide
GSSESGSSEGGPGSSESGSSEGGPGSSESGSSEGGP

SEQ ID NO: 293 - DNA, 108 bp, Artificial Sequence
  Description of Artificial Sequence: Synthetic polynucleotide
ggttcctccgaaagcggttcttctgagggcggtccaggttcctccgaaagcggttcttccgagggcggtccaggttcttctgaaagcggttcttccgagggcggtcca

SEQ ID NO: 294 - protein, 36 aa, Artificial Sequence
  Description of Artificial Sequence: Synthetic polypeptide
GSGGEPSESGSSGSEGSSGPGESSGSSESGSSEGGP

SEQ ID NO: 295 - DNA, 108 bp, Artificial Sequence
  Description of Artificial Sequence: Synthetic polynucleotide
ggttccggtggcgaaccgtccgaatctggtagctcaggtagcgaaggttcttctggtccaggcgaatcttcaggttcctctgaaagcggttcttctgagggcggtcca

SEQ ID NO: 296 - protein, 36 aa, Artificial Sequence; identical to SEQ ID NO: 282
  Description of Artificial Sequence: Synthetic polypeptide

SEQ ID NO: 297 - DNA, 108 bp, Artificial Sequence
  Description of Artificial Sequence: Synthetic polynucleotide
ggttctggtggtgaaccgtccgaatctggtagctcaggttcttccgaaagcggttcttctgaaggtggtccaggttccggtggcgaaccttctgaatctggtagctca

SEQ ID NO: 298 - protein, 36 aa, Artificial Sequence
  Description of Artificial Sequence: Synthetic polypeptide
GSGGEPSESGSSGSSESGSSEGGPGESPGGSSGSES

SEQ ID NO: 299 - DNA, 108 bp, Artificial Sequence
  Description of Artificial Sequence: Synthetic polynucleotide
ggttctggtggcgaaccgtccgaatctggtagctcaggttcctccgaaagcggttcttctgaaggtggtccaggtgaatctccaggtggttctagcggttctgaatca

SEQ ID NO: 300 - protein, 36 aa, Artificial Sequence
  Description of Artificial Sequence: Synthetic polypeptide
GSGGEPSESGSSGESPGGSSGSESGSEGSSGPGESS

SEQ ID NO: 301 - DNA, 108 bp, Artificial Sequence
  Description of Artificial Sequence: Synthetic polynucleotide
ggttctggtggcgaaccgtctgagtctggtagctcaggtgaatctcctggtggctccagcggttctgaatcaggtagcgaaggttcttctggtcctggtgaatcttca

SEQ ID NO: 302 - protein, 36 aa, Artificial Sequence
  Description of Artificial Sequence: Synthetic polypeptide
GSGGEPSESGSSGESPGGSSGSESGSGGEPSESGSS

SEQ ID NO: 303 - DNA, 108 bp, Artificial Sequence
  Description of Artificial Sequence: Synthetic polynucleotide
ggttccggtggcgaaccttccgaatctggtagctcaggtgaatctccgggtggttctagcggttctgagtcaggttctggtggtgaaccttccgagtctggtagctca

SEQ ID NO: 304 - protein, 36 aa, Artificial Sequence; identical to SEQ ID NO: 292
  Description of Artificial Sequence: Synthetic polypeptide

SEQ ID NO: 305 - DNA, 108 bp, Artificial Sequence
  Description of Artificial Sequence: Synthetic polynucleotide
ggttcctctgaaagcggttcttctgagggcggtccaggttcttccgaaagcggttcttccgagggcggtccaggttcttccgaaagcggttcttctgaaggcggtcca

SEQ ID NO: 306 - protein, 36 aa, Artificial Sequence
  Description of Artificial Sequence: Synthetic polypeptide
GESPGGSSGSESGSEGSSGPGESSGSEGSSGPGESS

SEQ ID NO: 307 - DNA, 108 bp, Artificial Sequence
  Description of Artificial Sequence: Synthetic polynucleotide
ggtgaatctccgggtggctccagcggttctgagtcaggtagcgaaggttcttccggtccgggtgagtcctcaggtagcgaaggttcttccggtcctggtgagtcttca

SEQ ID NO: 308 - protein, 36 aa, Artificial Sequence
  Description of Artificial Sequence: Synthetic polypeptide
GSGGEPSESGSSGSGGEPSESGSSGSSESGSSEGGP

SEQ ID NO: 309 - DNA, 108 bp, Artificial Sequence
  Description of Artificial Sequence: Synthetic polynucleotide
ggttctggtggcgaaccttccgaatctggtagctcaggttccggtggtgaaccttctgaatctggtagctcaggttcttctgaaagcggttcttccgagggcggtcca

SEQ ID NO: 310 - protein, 36 aa, Artificial Sequence
  Description of Artificial Sequence: Synthetic polypeptide
GSGGEPSESGSSGSGGEPSESGSSGSGGEPSESGSS

SEQ ID NO: 311 - DNA, 108 bp, Artificial Sequence
  Description of Artificial Sequence: Synthetic polynucleotide
ggttccggtggtgaaccttctgaatctggtagctcaggttccggtggcgaaccatccgagtctggtagctcaggttccggtggtgaaccatccgagtctggtagctca

SEQ ID NO: 312 - protein, 36 aa, Artificial Sequence
  Description of Artificial Sequence: Synthetic polypeptide
GSGGEPSESGSSGSSESGSSEGGPGSEGSSGPGESS

SEQ ID NO: 313 - DNA, 108 bp, Artificial Sequence
  Description of Artificial Sequence: Synthetic polynucleotide
ggttccggtggcgaaccttctgaatctggtagctcaggttcctccgaaagcggttcttctgagggcggtccaggtagcgaaggttcttctggtccgggcgagtcttca

SEQ ID NO: 314 - protein, 36 aa, Artificial Sequence
  Description of Artificial Sequence: Synthetic polypeptide
GSGGEPSESGSSGSEGSSGPGESSGSGGEPSESGSS

SEQ ID NO: 315 - DNA, 108 bp, Artificial Sequence
  Description of Artificial Sequence: Synthetic polynucleotide
ggttccggtggtgaaccgtccgagtctggtagctcaggtagcgaaggttcttctggtccgggtgagtcttcaggttctggtggcgaaccgtccgaatctggtagctca

SEQ ID NO: 316 - protein, 36 aa, Artificial Sequence; identical to SEQ ID NO: 302
  Description of Artificial Sequence: Synthetic polypeptide

SEQ ID NO: 317 - DNA, 108 bp, Artificial Sequence
  Description of Artificial Sequence: Synthetic polynucleotide
ggttctggtggcgaaccgtccgaatctggtagctcaggtgaatctcctggtggttccagcggttccgagtcaggttctggtggcgaaccttccgaatctggtagctca

SEQ ID NO: 318 - protein, 36 aa, Artificial Sequence
  Description of Artificial Sequence: Synthetic polypeptide
GSSESGSSEGGPGSGGEPSESGSSGSSESGSSEGGP

SEQ ID NO: 319 - DNA, 108 bp, Artificial Sequence
  Description of Artificial Sequence: Synthetic polynucleotide
ggttcttccgaaagcggttcttccgagggcggtccaggttccggtggtgaaccatctgaatctggtagctcaggttcttctgaaagcggttcttctgaaggtggtcca

SEQ ID NO: 320 - protein, 36 aa, Artificial Sequence
  Description of Artificial Sequence: Synthetic polypeptide
GSEGSSGPGESSGESPGGSSGSESGSEGSSGPGESS

SEQ ID NO: 321 - DNA, 108 bp, Artificial Sequence
  Description of Artificial Sequence: Synthetic polynucleotide
ggtagcgaaggttcttccggtcctggtgagtcttcaggtgaatctccaggtggctctagcggttccgagtcaggtagcgaaggttcttctggtcctggcgagtcctca

SEQ ID NO: 322 - protein, 36 aa, Artificial Sequence; identical to SEQ ID NO: 292
  Description of Artificial Sequence: Synthetic polypeptide

SEQ ID NO: 323 - DNA, 108 bp, Artificial Sequence
  Description of Artificial Sequence: Synthetic polynucleotide
ggttcctctgaaagcggttcttccgaaggcggtccaggttcttccgaaagcggttcttctgagggcggtccaggttcctccgaaagcggttcttctgagggtggtcca

SEQ ID NO: 324 - protein, 36 aa, Artificial Sequence; identical to SEQ ID NO: 276
  Description of Artificial Sequence: Synthetic polypeptide

SEQ ID NO: 325 - DNA, 108 bp, Artificial Sequence
  Description of Artificial Sequence: Synthetic polynucleotide
ggttctggtggcgaaccttccgagtctggtagctcaggtgaatctccgggtggttctagcggttccgagtcaggtgaatctccgggtggttccagcggttctgagtca

SEQ ID NO: 326 - protein, 36 aa, Artificial Sequence
  Description of Artificial Sequence: Synthetic polypeptide
GSGGEPSESGSSGSEGSSGPGESSGESPGGSSGSES

SEQ ID NO: 327 - DNA, 108 bp, Artificial Sequence
  Description of Artificial Sequence: Synthetic polynucleotide
ggttctggtggcgaaccatctgagtctggtagctcaggtagcgaaggttcttccggtccaggcgagtcttcaggtgaatctcctggtggctccagcggttctgagtca

SEQ ID NO: 328 - protein, 36 aa, Artificial Sequence
  Description of Artificial Sequence: Synthetic polypeptide
GESPGGSSGSESGESPGGSSGSESGESPGGSSGSES

SEQ ID NO: 329 - DNA, 108 bp, Artificial Sequence
  Description of Artificial Sequence: Synthetic polynucleotide
ggtgaatctcctggtggttccagcggttccgagtcaggtgaatctccaggtggctctagcggttccgagtcaggtgaatctcctggtggttctagcggttctgaatca

SEQ ID NO: 330 - protein, 36 aa, Artificial Sequence
  Description of Artificial Sequence: Synthetic polypeptide
GSEGSSGPGESSGSEGSSGPGESSGSGGEPSESGSS

SEQ ID NO: 331 - DNA, 108 bp, Artificial Sequence
  Description of Artificial Sequence: Synthetic polynucleotide
ggtagcgaaggttcttccggtccaggtgaatcttcaggtagcgaaggttcttctggtcctggtgaatcctcaggttccggtggcgaaccatctgaatctggtagctca

SEQ ID NO: 332 - protein, 36 aa, Artificial Sequence; identical to SEQ ID NO: 326
  Description of Artificial Sequence: Synthetic polypeptide

SEQ ID NO: 333 - DNA, 108 bp, Artificial Sequence
  Description of Artificial Sequence: Synthetic polynucleotide
ggttctggtggcgaaccatccgaatctggtagctcaggtagcgaaggttcttctggtcctggcgaatcttcaggtgaatctccaggtggctctagcggttccgaatca

SEQ ID NO: 334 - protein, 36 aa, Artificial Sequence; identical to SEQ ID NO: 282
  Description of Artificial Sequence: Synthetic polypeptide

SEQ ID NO: 335 - DNA, 108 bp, Artificial Sequence
  Description of Artificial Sequence: Synthetic polynucleotide
ggttccggtggtgaaccgtccgaatctggtagctcaggttcctctgaaagcggttcttccgagggtggtccaggttccggtggtgaaccttctgagtctggtagctca

SEQ ID NO: 336 - protein, 36 aa, Artificial Sequence
  Description of Artificial Sequence: Synthetic polypeptide
GSSESGSSEGGPGSGGEPSESGSSGSEGSSGPGESS

SEQ ID NO: 337 - DNA, 108 bp, Artificial Sequence
  Description of Artificial Sequence: Synthetic polynucleotide
ggttcctctgaaagcggttcttctgagggcggtccaggttctggtggcgaaccatctgaatctggtagctcaggtagcgaaggttcttccggtccgggtgaatcttca

SEQ ID NO: 338 - protein, 36 aa, Artificial Sequence
  Description of Artificial Sequence: Synthetic polypeptide
GSGGEPSESGSSGSEGSSGPGESSGSEGSSGPGESS

SEQ ID NO: 339 - DNA, 108 bp, Artificial Sequence
  Description of Artificial Sequence: Synthetic polynucleotide
ggttctggtggtgaaccgtccgaatctggtagctcaggtagcgaaggttcttctggtcctggcgagtcttcaggtagcgaaggttcttctggtcctggtgaatcttca

SEQ ID NO: 340 - protein, 36 aa, Artificial Sequence; identical to SEQ ID NO: 282
  Description of Artificial Sequence: Synthetic polypeptide

SEQ ID NO: 341 - DNA, 108 bp, Artificial Sequence
  Description of Artificial Sequence: Synthetic polynucleotide
ggttctggtggcgaaccatccgagtctggtagctcaggttcttccgaaagcggttcttccgaaggcggtccaggttctggtggtgaaccgtccgaatctggtagctca

SEQ ID NO: 342 - protein, 36 aa, Artificial Sequence; identical to SEQ ID NO: 276
  Description of Artificial Sequence: Synthetic polypeptide

SEQ ID NO: 343 - DNA, 108 bp, Artificial Sequence
  Description of Artificial Sequence: Synthetic polynucleotide
ggttccggtggcgaaccttccgaatctggtagctcaggtgaatctccgggtggttctagcggttccgaatcaggtgaatctccaggtggttctagcggttccgaatca

SEQ ID NO: 344 - protein, 36 aa, Artificial Sequence
  Description of Artificial Sequence: Synthetic polypeptide
GSGGEPSESGSSGSGGEPSESGSSGESPGGSSGSES

SEQ ID NO: 345 - DNA, 108 bp, Artificial Sequence
  Description of Artificial Sequence: Synthetic polynucleotide
ggttccggtggtgaaccatctgagtctggtagctcaggttccggtggcgaaccgtccgagtctggtagctcaggtgaatctccgggtggttccagcggttccgaatca

SEQ ID NO: 346 - protein, 36 aa, Artificial Sequence
  Description of Artificial Sequence: Synthetic polypeptide
GSEGSSGPGESSGSSESGSSEGGPGSEGSSGPGESS

SEQ ID NO: 347 - DNA, 108 bp, Artificial Sequence
  Description of Artificial Sequence: Synthetic polynucleotide
ggtagcgaaggttcttctggtccgggcgaatcctcaggttcctccgaaagcggttcttccgaaggtggtccaggtagcgaaggttcttccggtcctggtgaatcttca

SEQ ID NO: 348 - protein, 36 aa, Artificial Sequence
  Description of Artificial Sequence: Synthetic polypeptide
GSSESGSSEGGPGESPGGSSGSESGESPGGSSGSES

SEQ ID NO: 349 - DNA, 108 bp, Artificial Sequence
  Description of Artificial Sequence: Synthetic polynucleotide
ggttcctctgaaagcggttcttctgaaggcggtccaggtgaatctccgggtggctccagcggttctgaatcaggtgaatctcctggtggctccagcggttccgagtca

SEQ ID NO: 350 - protein, 36 aa, Artificial Sequence; identical to SEQ ID NO: 330
  Description of Artificial Sequence: Synthetic polypeptide

SEQ ID NO: 351 - DNA, 108 bp, Artificial Sequence
  Description of Artificial Sequence: Synthetic polynucleotide
ggtagcgaaggttcttctggtccaggcgagtcttcaggtagcgaaggttcttccggtcctggcgagtcttcaggttccggtggcgaaccgtccgaatctggtagctca

SEQ ID NO: 352 - protein, 12 aa, Artificial Sequence
  Description of Artificial Sequence: Synthetic peptide
GSPAGSPTSTEE

SEQ ID NO: 353 - protein, 12 aa, Artificial Sequence
  Description of Artificial Sequence: Synthetic peptide
GSEPATSGSETP

SEQ ID NO: 354 - protein, 12 aa, Artificial Sequence
  Description of Artificial Sequence: Synthetic peptide
GTSESATPESGP

SEQ ID NO: 355 - protein, 12 aa, Artificial Sequence
  Description of Artificial Sequence: Synthetic peptide
GTSTEPSEGSAP

SEQ ID NO: 356 - DNA, 36 bp, Artificial Sequence
  Description of Artificial Sequence: Synthetic oligonucleotide
aggtagcccdgcwggytctccdacytcyacygarga

SEQ ID NO: 357 - DNA, 36 bp, Artificial Sequence
  Description of Artificial Sequence: Synthetic oligonucleotide
accttcytcrgtrgargthggagarccwgchgggct

SEQ ID NO: 358 - DNA, 36 bp, Artificial Sequence
  Description of Artificial Sequence: Synthetic oligonucleotide
aggtagcgaacckgcwacytcyggytctgaracycc

SEQ ID NO: 359 - DNA, 36 bp, Artificial Sequence
  Description of Artificial Sequence: Synthetic oligonucleotide
acctggrgtytcagarccrgargtwgcmggttcgct

SEQ ID NO: 360 - DNA, 36 bp, Artificial Sequence
  Description of Artificial Sequence: Synthetic oligonucleotide
aggtacytctgaaagcgcwacycckgartcyggycc

SEQ ID NO: 361 - DNA, 36 bp, Artificial Sequence
  Description of Artificial Sequence: Synthetic oligonucleotide
acctggrccrgaytcmggrgtwgcgctttcagargt

SEQ ID NO: 362 - DNA, 36 bp, Artificial Sequence
  Description of Artificial Sequence: Synthetic oligonucleotide
aggtacytctacygaaccktcygarggyagcgcwcc

SEQ ID NO: 363 - DNA, 36 bp, Artificial Sequence
  Description of Artificial Sequence: Synthetic oligonucleotide
acctggwgcgctrccytcrgamggttcrgtagargt

SEQ ID NO: 364 - DNA, 24 bp, Artificial Sequence
  Description of Artificial Sequence: Synthetic oligonucleotide
aggttcgtcttcactcgagggtac

SEQ ID NO: 365 - DNA, 16 bp, Artificial Sequence
  Description of Artificial Sequence: Synthetic oligonucleotide
cctcgagtgaagacga

SEQ ID NO: 366 - protein, 36 aa, Artificial Sequence
  Description of Artificial Sequence: Synthetic polypeptide
GSPAGSPTSTEEGTSESATPESGPGTSTEPSEGSAP

SEQ ID NO: 367 - DNA, 108 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcacca

SEQ ID NO: 368 - protein, 36 aa, Artificial Sequence
  Description of Artificial Sequence: Synthetic polypeptide
GTSTEPSEGSAPGTSTEPSEGSAPGTSTEPSEGSAP

SEQ ID NO: 369 - DNA, 108 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcacca

SEQ ID NO: 370 - protein, 36 aa, Artificial Sequence
  Description of Artificial Sequence: Synthetic polypeptide
GTSTEPSEGSAPGTSESATPESGPGTSESATPESGP

SEQ ID NO: 371 - DNA, 108 bp, Artificial Sequence
  Description of Artificial Sequence: Synthetic polynucleotide
ggtacctctaccgaaccgtctgaaggtagcgcaccaggtacctctgaaagcgcaactcctgagtccggtccaggtacttctgaaagcgcaaccccggagtctggccca

SEQ ID NO: 372 - protein, 36 aa, Artificial Sequence; identical to SEQ ID NO: 370
  Description of Artificial Sequence: Synthetic polypeptide

SEQ ID NO: 373 - DNA, 108 bp, Artificial Sequence
  Description of Artificial Sequence: Synthetic polynucleotide
ggtacttctactgaaccgtctgaaggtagcgcaccaggtacttctgaaagcgcaaccccggaatccggcccaggtacctctgaaagcgcaaccccggagtccggccca

SEQ ID NO: 374 - protein, 36 aa, Artificial Sequence
  Description of Artificial Sequence: Synthetic polypeptide
GSEPATSGSETPGTSESATPESGPGSPAGSPTSTEE

SEQ ID NO: 375 - DNA, 108 bp, Artificial Sequence
  Description of Artificial Sequence: Synthetic polynucleotide
ggtagcgaaccggcaacctccggctctgaaaccccaggtacctctgaaagcgctactcctgaatccggcccaggtagcccggcaggttctccgacttccactgaggaa

SEQ ID NO: 376 - protein, 36 aa, Artificial Sequence
  Description of Artificial Sequence: Synthetic polypeptide
GTSESATPESGPGSEPATSGSETPGTSTEPSEGSAP

SEQ ID NO: 377 - DNA, 108 bp, Artificial Sequence
  Description of Artificial Sequence: Synthetic polynucleotide
ggtacttctgaaagcgcaacccctgaatccggtccaggtagcgaaccggctacttctggctctgagactccaggtacttctaccgaaccgtccgaaggtagcgcacca

SEQ ID NO: 378 - protein, 36 aa, Artificial Sequence
  Description of Artificial Sequence: Synthetic polypeptide
GSPAGSPTSTEEGSPAGSPTSTEEGSEPATSGSETP

SEQ ID NO: 379 - DNA, 108 bp, Artificial Sequence
  Description of Artificial Sequence: Synthetic polynucleotide
ggtagcccggctggctctccaacctccactgaggaaggtagcccggctggctctccaacctccactgaagaaggtagcgaaccggctacctccggctctgaaactcca

SEQ ID NO: 380 - protein, 36 aa, Artificial Sequence; identical to SEQ ID NO: 366
  Description of Artificial Sequence: Synthetic polypeptide

SEQ ID NO: 381 - DNA, 108 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctcca

SEQ ID NO: 382 - protein, 36 aa, Artificial Sequence
  Description of Artificial Sequence: Synthetic polypeptide
GSPAGSPTSTEEGSPAGSPTSTEEGTSTEPSEGSAP

SEQ ID NO: 383 - DNA, 108 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctcca

SEQ ID NO: 384 - protein, 36 aa, Artificial Sequence
  Description of Artificial Sequence: Synthetic polypeptide
GTSESATPESGPGTSTEPSEGSAPGTSTEPSEGSAP

SEQ ID NO: 385 - DNA, 108 bp, Artificial Sequence
  Description of Artificial Sequence: Synthetic polynucleotide
ggtacttctgaaagcgctactccggagtccggtccaggtacctctaccgaaccgtccgaaggcagcgctccaggtacttctactgaaccttctgagggtagcgctcca

SEQ ID NO: 386 - protein, 36 aa, Artificial Sequence
  Description of Artificial Sequence: Synthetic polypeptide
GTSTEPSEGSAPGSPAGSPTSTEEGTSTEPSEGSAP

SEQ ID NO: 387 - DNA, 108 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcacca

SEQ ID NO: 388 - protein, 36 aa, Artificial Sequence
  Description of Artificial Sequence: Synthetic polypeptide
GSEPATSGSETPGSPAGSPTSTEEGTSESATPESGP

SEQ ID NO: 389 - DNA, 108 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggccca

SEQ ID NO: 390 - protein, 36 aa, Artificial Sequence; identical to SEQ ID NO: 370
  Description of Artificial Sequence: Synthetic polypeptide

SEQ ID NO: 391 - DNA, 108 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtcca

SEQ ID NO: 392 - protein, 36 aa, Artificial Sequence
  Description of Artificial Sequence: Synthetic polypeptide
GTSTEPSEGSAPGSEPATSGSETPGSPAGSPTSTEE

SEQ ID NO: 393 - DNA, 108 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaa

SEQ ID NO: 394 - protein, 36 aa, Artificial Sequence
  Description of Artificial Sequence: Synthetic polypeptide
GSPAGSPTSTEEGTSESATPESGPGSEPATSGSETP

SEQ ID NO: 395 - DNA, 108 bp, Artificial Sequence
  Description of Artificial Sequence: Synthetic polynucleotide
ggtagccctgctggctctccaacctccaccgaagaaggtacctctgaaagcgcaacccctgaatccggcccaggtagcgaaccggcaacctccggttctgaaacccca

SEQ ID NO: 396 - protein, 36 aa, Artificial Sequence
  Description of Artificial Sequence: Synthetic polypeptide
GTSESATPESGPGSPAGSPTSTEEGSPAGSPTSTEE

SEQ ID NO: 397 - DNA, 108 bp, Artificial Sequence
  Description of Artificial Sequence: Synthetic polynucleotide
ggtacttctgaaagcgctactcctgagtccggcccaggtagcccggctggctctccgacttccaccgaggaaggtagcccggctggctctccaacttctactgaagaa

SEQ ID NO: 398 - protein, 36 aa, Artificial Sequence
  Description of Artificial Sequence: Synthetic polypeptide
GTSTEPSEGSAPGTSESATPESGPGTSTEPSEGSAP

SEQ ID NO: 399 - DNA, 108 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcacca

SEQ ID NO: 400 - protein, 36 aa, Artificial Sequence
  Description of Artificial Sequence: Synthetic polypeptide
GSPAGSPTSTEEGTSTEPSEGSAPGSEPATSGSETP

SEQ ID NO: 401 - DNA, 108 bp, Artificial Sequence
  Description of Artificial Sequence: Synthetic polynucleotide
ggtagcccggcaggctctccgacttccaccgaggaaggtacctctactgaaccttctgagggtagcgctccaggtagcgaaccggcaacctctggctctgaaacccca

SEQ ID NO: 402 - protein, 36 aa, Artificial Sequence
  Description of Artificial Sequence: Synthetic polypeptide
GSPAGSPTSTEEGTSTEPSEGSAPGTSTEPSEGSAP

SEQ ID NO: 403 - DNA, 108 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctcca

SEQ ID NO: 404 - protein, 36 aa, Artificial Sequence; identical to SEQ ID NO: 374
  Description of Artificial Sequence: Synthetic polypeptide

SEQ ID NO: 405 - DNA, 108 bp, Artificial Sequence
  Description of Artificial Sequence: Synthetic polynucleotide
ggtagcgaacctgctacctccggttctgaaaccccaggtacctctgaaagcgcaactccggagtctggtccaggtagccctgcaggttctcctacctccactgaggaa

SEQ ID NO: 406 - protein, 36 aa, Artificial Sequence; identical to SEQ ID NO: 384
  Description of Artificial Sequence: Synthetic polypeptide

SEQ ID NO: 407 - DNA, 108 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcacca

SEQ ID NO: 408 - protein, 36 aa, Artificial Sequence; identical to SEQ ID NO: 402
  Description of Artificial Sequence: Synthetic polypeptide

SEQ ID NO: 409 - DNA, 108 bp, Artificial Sequence
  Description of Artificial Sequence: Synthetic polynucleotide
ggtagcccggctggttctccgacttccaccgaggaaggtacctctactgaaccttctgagggtagcgctccaggtacctctactgaaccttccgaaggcagcgctcca

SEQ ID NO: 410 - protein, 36 aa, Artificial Sequence; identical to SEQ ID NO: 368
  Description of Artificial Sequence: Synthetic polypeptide

SEQ ID NO: 411 - DNA, 108 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcacca

SEQ ID NO: 412 - protein, 36 aa, Artificial Sequence
  Description of Artificial Sequence: Synthetic polypeptide
GSEPATSGSETPGTSESATPESGPGTSTEPSEGSAP

SEQ ID NO: 413 - DNA, 108 bp, Artificial Sequence
  Description of Artificial Sequence: Synthetic polynucleotide
ggtagcgaacctgcaacctctggctctgaaaccccaggtacctctgaaagcgctactcctgaatctggcccaggtacttctactgaaccgtccgagggcagcgcacca

SEQ ID NO: 414 - protein, 36 aa, Artificial Sequence; identical to SEQ ID NO: 386
  Description of Artificial Sequence: Synthetic polypeptide

SEQ ID NO: 415 - DNA, 108 bp, Artificial Sequence
  Description of Artificial Sequence: Synthetic polynucleotide
ggtacttctaccgaaccgtccgagggtagcgcaccaggtagcccagcaggttctcctacctccaccgaggaaggtacttctaccgaaccgtccgagggtagcgcacca

SEQ ID NO: 416 - protein, 36 aa, Artificial Sequence
  Description of Artificial Sequence: Synthetic polypeptide
GSEPATSGSETPGTSESATPESGPGSEPATSGSETP

SEQ ID NO: 417 - DNA, 108 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaacccca

SEQ ID NO: 418 - protein, 36 aa, Artificial Sequence; identical to SEQ ID NO: 416
  Description of Artificial Sequence: Synthetic polypeptide

SEQ ID NO: 419 - DNA, 108 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaacccca

SEQ ID NO: 420 - protein, 36 aa, Artificial Sequence
  Description of Artificial Sequence: Synthetic polypeptide
GSEPATSGSETPGSEPATSGSETPGTSTEPSEGSAP

SEQ ID NO: 421 - DNA, 108 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcacca

SEQ ID NO: 422 - protein, 36 aa, Artificial Sequence
  Description of Artificial Sequence: Synthetic polypeptide
GTSESATPESGPGSEPATSGSETPGSEPATSGSETP

SEQ ID NO: 423 - DNA, 108 bp, Artificial Sequence
  Description of Artificial Sequence: Synthetic polynucleotide
ggtacttctgaaagcgctaccccggaatctggcccaggtagcgaaccggctacttctggttctgaaaccccaggtagcgaaccggctacctccggttctgaaactcca

SEQ ID NO: 424 - protein, 36 aa, Artificial Sequence
  Description of Artificial Sequence: Synthetic polypeptide
GTSTEPSEGSAPGTSTEPSEGSAPGTSESATPESGP

SEQ ID NO: 425 - DNA, 108 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtcca

SEQ ID NO: 426 - protein, 36 aa, Artificial Sequence
  Description of Artificial Sequence: Synthetic polypeptide
GSEPATSGSETPGTSESATPESGPGTSESATPESGP

SEQ ID NO: 427 - DNA, 108 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtcca

SEQ ID NO: 428 - protein, 36 aa, Artificial Sequence; identical to SEQ ID NO: 420
  Description of Artificial Sequence: Synthetic polypeptide

SEQ ID NO: 429 - DNA, 108 bp, Artificial Sequence
  Description of Artificial Sequence: Synthetic polynucleotide
ggtagcgaacctgctacctccggctctgaaactccaggtagcgaaccggctacttccggttctgaaactccaggtacctctaccgaaccttccgaaggcagcgcacca

SEQ ID NO: 430 - protein, 36 aa, Artificial Sequence
  Description of Artificial Sequence: Synthetic polypeptide
GSEPATSGSETPGTSTEPSEGSAPGSEPATSGSETP

SEQ ID NO: 431 - DNA, 108 bp, Artificial Sequence
  Description of Artificial Sequence: Synthetic polynucleotide
ggtagcgaacctgctacttctggttctgaaactccaggtacttctaccgaaccgtccgagggtagcgctccaggtagcgaacctgctacttctggttctgaaactcca

SEQ ID NO: 432 - protein, 36 aa, Artificial Sequence
  Description of Artificial Sequence: Synthetic polypeptide
GTSTEPSEGSAPGTSTEPSEGSAPGSEPATSGSETP

SEQ ID NO: 433 - DNA, 108 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactcca

SEQ ID NO: 434 - protein, 36 aa, Artificial Sequence; identical to SEQ ID NO: 392
  Description of Artificial Sequence: Synthetic polypeptide

SEQ ID NO: 435 - DNA, 108 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaa

SEQ ID NO: 436 - protein, 36 aa, Artificial Sequence; identical to SEQ ID NO: 388
  Description of Artificial Sequence: Synthetic polypeptide

SEQ ID NO: 437 - DNA, 108 bp, Artificial Sequence
  Description of Artificial Sequence: Synthetic polynucleotide
ggtagcgaaccggctacttccggctctgagactccaggtagcccagctggttctccaacctctactgaggaaggtacttctgaaagcgctacccctgaatctggtcca

SEQ ID NO: 438 - protein, 36 aa, Artificial Sequence
  Description of Artificial Sequence: Synthetic polypeptide
GTSESATPESGPGSEPATSGSETPGTSESATPESGP

SEQ ID NO: 439 - DNA, 108 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtcca

SEQ ID NO: 440 - protein, 12 aa, Artificial Sequence
  Description of Artificial Sequence: Synthetic peptide
GSTSESPSGTAP

SEQ ID NO: 441 - protein, 12 aa, Artificial Sequence
  Description of Artificial Sequence: Synthetic peptide
GTSTPESGSASP

SEQ ID NO: 442 - protein, 12 aa, Artificial Sequence
  Description of Artificial Sequence: Synthetic peptide
GTSPSGESSTAP

SEQ ID NO: 443 - protein, 12 aa, Artificial Sequence
  Description of Artificial Sequence: Synthetic peptide
GSTSSTAESPGP

SEQ ID NO: 444 - DNA, 36 bp, Artificial Sequence
  Description of Artificial Sequence: Synthetic oligonucleotide
aggttctacyagcgaatcyccktctggyacygcwcc

SEQ ID NO: 445 - DNA, 36 bp, Artificial Sequence
  Description of Artificial Sequence: Synthetic oligonucleotide
acctggwgcrgtrccagamggrgattcgctrgtaga

SEQ ID NO: 446 - DNA, 36 bp, Artificial Sequence
  Description of Artificial Sequence: Synthetic oligonucleotide
aggtacytctacycckgaaagcggytcygcwtctcc

SEQ ID NO: 447 - DNA, 36 bp, Artificial Sequence
  Description of Artificial Sequence: Synthetic oligonucleotide
acctggagawgcrgarccgctttcmggrgtagargt

SEQ ID NO: 448 - DNA, 36 bp, Artificial Sequence
  Description of Artificial Sequence: Synthetic oligonucleotide
aggtacytcycckagcggygaatcttctacygcwcc

SEQ ID NO: 449 - DNA, 36 bp, Artificial Sequence
  Description of Artificial Sequence: Synthetic oligonucleotide
acctggwgcrgtagaagattcrccgctmggrgargt

SEQ ID NO: 450 - DNA, 36 bp, Artificial Sequence
  Description of Artificial Sequence: Synthetic oligonucleotide
aggttcyacyagctctacygcwgaatctcckggycc

SEQ ID NO: 451 - DNA, 36 bp, Artificial Sequence
  Description of Artificial Sequence: Synthetic oligonucleotide
acctggrccmggagattcwgcrgtagagctrgtrga

SEQ ID NO: 452 - DNA, 24 bp, Artificial Sequence
  Description of Artificial Sequence: Synthetic oligonucleotide
aggttcgtcttcactcgagggtac

SEQ ID NO: 453 - DNA, 16 bp, Artificial Sequence
  Description of Artificial Sequence: Synthetic oligonucleotide
cctcgagtgaagacga

SEQ ID NO: 454 - protein, 36 aa, Artificial Sequence
  Description of Artificial Sequence: Synthetic polypeptide
GTSTPESGSASPGTSPSGESSTAPGTSPSGESSTAP

SEQ ID NO: 455 - DNA, 108 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctcca

SEQ ID NO: 456 - protein, 36 aa, Artificial Sequence
  Description of Artificial Sequence: Synthetic polypeptide
GTSPSGESSTAPGSTSSTAESPGPGTSPSGESSTAP

SEQ ID NO: 457 - DNA, 108 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctcca

SEQ ID NO: 458 - protein, 36 aa, Artificial Sequence
  Description of Artificial Sequence: Synthetic polypeptide
GSTSSTAESPGPGTSPSGESSTAPGTSTPESGSASP

SEQ ID NO: 459 - DNA, 108 bp, Artificial Sequence
  Description of Artificial Sequence: Synthetic polynucleotide
ggttccaccagctctactgctgaatctcctggtccaggtacctctcctagcggtgaatcttctactgctccaggtacttctactcctgaaagcggctctgcttctcca

SEQ ID NO: 460 - protein, 36 aa, Artificial Sequence
  Description of Artificial Sequence: Synthetic polypeptide
GSTSSTAESPGPGSTSSTAESPGPGTSPSGESSTAP

SEQ ID NO: 461 - DNA, 108 bp, Artificial Sequence
  Description of Artificial Sequence: Synthetic polynucleotide
ggttctaccagctctactgcagaatctcctggcccaggttccaccagctctaccgcagaatctccgggtccaggtacttcccctagcggtgaatcttctaccgcacca

SEQ ID NO: 462 - protein, 36 aa, Artificial Sequence; identical to SEQ ID NO: 458
  Description of Artificial Sequence: Synthetic polypeptide

SEQ ID NO: 463 - DNA, 108 bp, Artificial Sequence
  Description of Artificial Sequence: Synthetic polynucleotide
ggttctactagctctactgctgaatctcctggcccaggtacttctcctagcggtgaatcttctaccgctccaggtacctctactccggaaagcggttctgcatctcca

SEQ ID NO: 464 - protein, 36 aa, Artificial Sequence
  Description of Artificial Sequence: Synthetic polypeptide
GSTSSTAESPGPGTSTPESGSASPGSTSESPSGTAP

SEQ ID NO: 465 - DNA, 108 bp, Artificial Sequence
  Description of Artificial Sequence: Synthetic polynucleotide
ggttctaccagctctaccgcagaatctcctggtccaggtacctctactccggaaagcggctctgcatctccaggttctactagcgaatctccttctggcactgcacca

SEQ ID NO: 466 - protein, 36 aa, Artificial Sequence
  Description of Artificial Sequence: Synthetic polypeptide
GSTSSTAESPGPGTSTPESGSASPGTSTPESGSASP

SEQ ID NO: 467 - DNA, 108 bp, Artificial Sequence
  Description of Artificial Sequence: Synthetic polynucleotide
ggttctactagctctactgcagaatctcctggcccaggtacctctactccggaaagcggctctgcatctccaggtacttctacccctgaaagcggttctgcatctcca

SEQ ID NO: 468 - protein, 36 aa, Artificial Sequence
  Description of Artificial Sequence: Synthetic polypeptide
GSTSESPSGTAPGTSPSGESSTAPGSTSESPSGTAP

SEQ ID NO: 469 - DNA, 108 bp, Artificial Sequence
  Description of Artificial Sequence: Synthetic polynucleotide
ggttctaccagcgaatctccttctggcaccgctccaggtacctctcctagcggcgaatcttctaccgctccaggttctactagcgaatctccttctggcactgcacca

SEQ ID NO: 470 - protein, 36 aa, Artificial Sequence; identical to SEQ ID NO: 460
  Description of Artificial Sequence: Synthetic polypeptide

SEQ ID NO: 471 - DNA, 108 bp, Artificial Sequence
  Description of Artificial Sequence: Synthetic polynucleotide
ggttccaccagctctactgcagaatctccgggcccaggttctactagctctactgcagaatctccgggtccaggtacttctcctagcggcgaatcttctaccgctcca

SEQ ID NO: 472 - protein, 36 aa, Artificial Sequence; identical to SEQ ID NO: 464
  Description of Artificial Sequence: Synthetic polypeptide

SEQ ID NO: 473 - DNA, 108 bp, Artificial Sequence
  Description of Artificial Sequence: Synthetic polynucleotide
ggttccactagctctactgcagaatctcctggcccaggtacctctacccctgaaagcggctctgcatctccaggttctaccagcgaatccccgtctggcaccgcacca

SEQ ID NO: 474 - protein, 36 aa, Artificial Sequence; identical to SEQ ID NO: 460
  Description of Artificial Sequence: Synthetic polypeptide

SEQ ID NO: 475 - DNA, 108 bp, Artificial Sequence
  Description of Artificial Sequence: Synthetic polynucleotide
ggttctactagctctactgctgaatctccgggtccaggttctaccagctctactgctgaatctcctggtccaggtacctccccgagcggtgaatcttctactgcacca

SEQ ID NO: 476 - protein, 36 aa, Artificial Sequence
  Description of Artificial Sequence: Synthetic polypeptide
GSTSSTAESPGPGSTSESPSGTAPGSTSSTAESPGP

SEQ ID NO: 477 - DNA, 108 bp, Artificial Sequence
  Description of Artificial Sequence: Synthetic polynucleotide
ggttctaccagctctaccgctgaatctcctggcccaggttctaccagcgaatccccgtctggcaccgcaccaggttctactagctctaccgctgaatctccgggtcca

SEQ ID NO: 478 - protein, 36 aa, Artificial Sequence
  Description of Artificial Sequence: Synthetic polypeptide
GSTSSTAESPGPGSTSSTAESPGPGSTSSTAESPGP

SEQ ID NO: 479 - DNA, 108 bp, Artificial Sequence
  Description of Artificial Sequence: Synthetic polynucleotide
ggttctaccagctctaccgcagaatctcctggcccaggttccactagctctaccgctgaatctcctggtccaggttctactagctctaccgctgaatctcctggtcca

SEQ ID NO: 480 - protein, 36 aa, Artificial Sequence
  Description of Artificial Sequence: Synthetic polypeptide
GSTSESPSGTAPGSTSSTAESPGPGSTSSTAESPGP

SEQ ID NO: 481 - DNA, 108 bp, Artificial Sequence
  Description of Artificial Sequence: Synthetic polynucleotide
ggttctactagcgaatccccttctggtactgctccaggttccactagctctaccgctgaatctcctggcccaggttccactagctctactgcagaatctcctggtcca

SEQ ID NO: 482 - protein, 36 aa, Artificial Sequence
  Description of Artificial Sequence: Synthetic polypeptide
GSTSESPSGTAPGSTSESPSGTAPGSTSESPSGTAP

SEQ ID NO: 483 - DNA, 108 bp, Artificial Sequence
  Description of Artificial Sequence: Synthetic polynucleotide
ggttctactagcgaatctccttctggtaccgctccaggttctaccagcgaatccccgtctggtactgctccaggttctaccagcgaatctccttctggtactgcacca

SEQ ID NO: 484 - protein, 36 aa, Artificial Sequence; identical to SEQ ID NO: 478
  Description of Artificial Sequence: Synthetic polypeptide

SEQ ID NO: 485 - DNA, 108 bp, Artificial Sequence
  Description of Artificial Sequence: Synthetic polynucleotide
ggttccaccagctctactgctgaatctcctggcccaggttctaccagctctactgctgaatctccgggcccaggttccaccagctctaccgctgaatctccgggtcca

SEQ ID NO: 486 - protein, 36 aa, Artificial Sequence; identical to SEQ ID NO: 460
  Description of Artificial Sequence: Synthetic polypeptide

SEQ ID NO: 487 - DNA, 108 bp, Artificial Sequence
  Description of Artificial Sequence: Synthetic polynucleotide
ggttccactagctctaccgcagaatctcctggtccaggttctactagctctactgctgaatctccgggtccaggtacctcccctagcggcgaatcttctaccgctcca

SEQ ID NO: 488 - protein, 36 aa, Artificial Sequence
  Description of Artificial Sequence: Synthetic polypeptide
GSSPSASTGTGPGSSTPSGATGSPGSSTPSGATGSP

SEQ ID NO: 489 - DNA, 108 bp, Artificial Sequence
  Description of Artificial Sequence: Synthetic polynucleotide
ggttctagcccttctgcttccaccggtaccggcccaggtagctctactccgtctggtgcaactggctctccaggtagctctactccgtctggtgcaaccggctcccca

SEQ ID NO: 490 - protein, 36 aa, Artificial Sequence
  Description of Artificial Sequence: Synthetic polypeptide
GTSPSGESSTAPGTSTPESGSASPGSTSSTAESPGP

SEQ ID NO: 491 - DNA, 108 bp, Artificial Sequence
  Description of Artificial Sequence: Synthetic polynucleotide
ggtacttcccctagcggtgaatcttctactgctccaggtacctctactccggaaagcggctccgcatctccaggttctactagctctactgctgaatctcctggtcca

SEQ ID NO: 492 - protein, 36 aa, Artificial Sequence
  Description of Artificial Sequence: Synthetic polypeptide
GSTSSTAESPGPGSTSSTAESPGPGTSTPESGSASP

SEQ ID NO: 493 - DNA, 108 bp, Artificial Sequence
  Description of Artificial Sequence: Synthetic polynucleotide
ggttctactagctctaccgctgaatctccgggtccaggttctaccagctctactgcagaatctcctggcccaggtacttctactccggaaagcggttccgcttctcca

SEQ ID NO: 494 - protein, 36 aa, Artificial Sequence
  Description of Artificial Sequence: Synthetic polypeptide
GTSPSGESSTAPGSTSSTAESPGPGTSTPESGSASP

SEQ ID NO: 495 - DNA, 108 bp, Artificial Sequence
  Description of Artificial Sequence: Synthetic polynucleotide
ggtacttctcctagcggtgaatcttctaccgctccaggttctaccagctctactgctgaatctcctggcccaggtacttctaccccggaaagcggctccgcttctcca

SEQ ID NO: 496 - protein, 36 aa, Artificial Sequence; identical to SEQ ID NO: 480
  Description of Artificial Sequence: Synthetic polypeptide

SEQ ID NO: 497 - DNA, 108 bp, Artificial Sequence
  Description of Artificial Sequence: Synthetic polynucleotide
ggttctactagcgaatccccttctggtactgcaccaggttctaccagctctactgctgaatctccgggcccaggttccaccagctctaccgcagaatctcctggtcca

SEQ ID NO: 498 - protein, 36 aa, Artificial Sequence; identical to SEQ ID NO: 476
  Description of Artificial Sequence: Synthetic polypeptide

SEQ ID NO: 499 - DNA, 108 bp, Artificial Sequence
  Description of Artificial Sequence: Synthetic polynucleotide
ggttccaccagctctaccgctgaatctccgggcccaggttctaccagcgaatccccttctggcactgcaccaggttctactagctctaccgcagaatctccgggccca

SEQ ID NO: 500 - protein, 36 aa, Artificial Sequence; identical to SEQ ID NO: 458
  Description of Artificial Sequence: Synthetic polypeptide

SEQ ID NO: 501 - DNA, 108 bp, Artificial Sequence
  Description of Artificial Sequence: Synthetic polynucleotide
ggttctaccagctctactgctgaatctccgggtccaggtacttccccgagcggtgaatcttctactgcaccaggtacttctactccggaaagcggttccgcttctcca

SEQ ID NO: 502 - protein, 36 aa, Artificial Sequence
  Description of Artificial Sequence: Synthetic polypeptide
GSTSESPSGTAPGSTSESPSGTAPGTSPSGESSTAP

SEQ ID NO: 503 - DNA, 108 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcacca

SEQ ID NO: 504 - protein, 36 aa, Artificial Sequence
  Description of Artificial Sequence: Synthetic polypeptide
GSTSESPSGTAPGSTSESPSGTAPGTSTPESGSASP

SEQ ID NO: 505 - DNA, 108 bp, Artificial Sequence
  Description of Artificial Sequence: Synthetic polynucleotide
ggttctaccagcgaatccccttctggtactgctccaggttctaccagcgaatccccttctggcaccgcaccaggtacttctacccctgaaagcggctccgcttctcca

SEQ ID NO: 506 - protein, 36 aa, Artificial Sequence
  Description of Artificial Sequence: Synthetic polypeptide
GTSTPESGSASPGSTSSTAESPGPGSTSSTAESPGP

SEQ ID NO: 507 - DNA, 108 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggccca

SEQ ID NO: 508 - protein, 36 aa, Artificial Sequence; identical to SEQ ID NO: 502
  Description of Artificial Sequence: Synthetic polypeptide

SEQ ID NO: 509 - DNA, 108 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctcca

SEQ ID NO: 510 - protein, 36 aa, Artificial Sequence
  Description of Artificial Sequence: Synthetic polypeptide
GSTSSTAESPGPGSTSSTAESPGPGSTSESPSGTAP

SEQ ID NO: 511 - DNA, 108 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctcca

SEQ ID NO: 512 - protein, 36 aa, Artificial Sequence; identical to SEQ ID NO: 492
  Description of Artificial Sequence: Synthetic polypeptide

SEQ ID NO: 513 - DNA, 108 bp, Artificial Sequence
  Description of Artificial Sequence: Synthetic polynucleotide
ggttccaccagctctactgcagaatctcctggcccaggttctactagctctaccgcagaatctcctggtccaggtacctctactcctgaaagcggttccgcatctcca

SEQ ID NO: 514 - protein, 36 aa, Artificial Sequence; identical to SEQ ID NO: 510
  Description of Artificial Sequence: Synthetic polypeptide

SEQ ID NO: 515 - DNA, 108 bp, Artificial Sequence
  Description of Artificial Sequence: Synthetic polynucleotide
ggttctactagctctactgctgaatctccgggcccaggttctactagctctaccgctgaatctccgggtccaggttctactagcgaatctccttctggtaccgctcca

SEQ ID NO: 516 - protein, 36 aa, Artificial Sequence
  Description of Artificial Sequence: Synthetic polypeptide
GTSPSGESSTAPGSTSESPSGTAPGSTSSTAESPGP

SEQ ID NO: 517 - DNA, 108 bp, Artificial Sequence
  Description of Artificial Sequence: Synthetic polynucleotide
ggtacctccccgagcggtgaatcttctactgcaccaggttctactagcgaatccccttctggtactgctccaggttccaccagctctactgcagaatctccgggtcca

SEQ ID NO: 518 - protein, 36 aa, Artificial Sequence
  Description of Artificial Sequence: Synthetic polypeptide
GSTSESPSGTAPGTSPSGESSTAPGSTSSTAESPGP

SEQ ID NO: 519 - DNA, 108 bp, Artificial Sequence
  Description of Artificial Sequence: Synthetic polynucleotide
ggttctactagcgaatccccgtctggtactgctccaggtacttcccctagcggtgaatcttctactgctccaggttctaccagctctaccgcagaatctccgggtcca

SEQ ID NO: 520 - protein, 36 aa, Artificial Sequence
  Description of Artificial Sequence: Synthetic polypeptide
GSTSSTAESPGPGSTSESPSGTAPGTSPSGESSTAP

SEQ ID NO: 521 - DNA, 108 bp, Artificial Sequence
  Description of Artificial Sequence: Synthetic polynucleotide
ggttctaccagctctaccgctgaatctcctggcccaggttctactagcgaatctccgtctggcaccgcaccaggtacttcccctagcggtgaatcttctactgcacca

SEQ ID NO: 522 - protein, 36 aa, Artificial Sequence; identical to SEQ ID NO: 504
  Description of Artificial Sequence: Synthetic polypeptide

SEQ ID NO: 523 - DNA, 108 bp, Artificial Sequence
  Description of Artificial Sequence: Synthetic polynucleotide
ggttctactagcgaatctccttctggcactgcaccaggttctaccagcgaatctccgtctggcactgcaccaggtacctctacccctgaaagcggttccgcttctcca

SEQ ID NO: 524 - protein, 36 aa, Artificial Sequence
  Description of Artificial Sequence: Synthetic polypeptide
GTSTPESGSASPGSTSESPSGTAPGSTSSTAESPGP

SEQ ID NO: 525 - DNA, 108 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggccca

SEQ ID NO: 526 - protein, 36 aa, Artificial Sequence
  Description of Artificial Sequence: Synthetic polypeptide
GSTSSTAESPGPGTSPSGESSTAPGTSPSGESSTAP

SEQ ID NO: 527 - DNA, 108 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctcca

SEQ ID NO: 528 - protein, 36 aa, Artificial Sequence
  Description of Artificial Sequence: Synthetic polypeptide
GTSPSGESSTAPGTSPSGESSTAPGTSPSGESSTAP

SEQ ID NO: 529 - DNA, 108 bp, Artificial Sequence
  Description of Artificial Sequence: Synthetic polynucleotide
ggtacctcccctagcggcgaatcttctactgctccaggtacctctcctagcggcgaatcttctaccgctccaggtacctcccctagcggtgaatcttctaccgcacca

SEQ ID NO: 530 - protein, 36 aa, Artificial Sequence; identical to SEQ ID NO: 464
  Description of Artificial Sequence: Synthetic polypeptide

SEQ ID NO: 531 - DNA, 108 bp, Artificial Sequence
  Description of Artificial Sequence: Synthetic polynucleotide
ggttccactagctctactgctgaatctcctggcccaggtacttctactccggaaagcggttccgcttctccaggttctactagcgaatctccgtctggcaccgcacca

SEQ ID NO: 532 - protein, 36 aa, Artificial Sequence
  Description of Artificial Sequence: Synthetic polypeptide
GSTSESPSGTAPGTSPSGESSTAPGTSPSGESSTAP

SEQ ID NO: 533 - DNA, 108 bp, Artificial Sequence
  Description of Artificial Sequence: Synthetic polynucleotide
ggttctactagcgaatctccgtctggcactgctccaggtacttctcctagcggtgaatcttctaccgctccaggtacttcccctagcggcgaatcttctaccgctcca

SEQ ID NO: 534 - protein, 36 aa, Artificial Sequence
  Description of Artificial Sequence: Synthetic polypeptide
GSTSESPSGTAPGTSTPESGSASPGSTSSTAESPGP

SEQ ID NO: 535 - DNA, 108 bp, Artificial Sequence
  Description of Artificial Sequence: Synthetic polynucleotide
ggttctactagcgaatctccttctggtaccgctccaggtacttctacccctgaaagcggctccgcttctccaggttccactagctctaccgctgaatctccgggtcca

SEQ ID NO: 536 - protein, 36 aa, Artificial Sequence; identical to SEQ ID NO: 510
  Description of Artificial Sequence: Synthetic polypeptide

SEQ ID NO: 537 - DNA, 108 bp, Artificial Sequence
  Description of Artificial Sequence: Synthetic polynucleotide
ggttccactagctctactgctgaatctcctggcccaggttctaccagctctaccgctgaatctcctggcccaggttctaccagcgaatctccgtctggcaccgcacca

SEQ ID NO: 538 - protein, 36 aa, Artificial Sequence
  Description of Artificial Sequence: Synthetic polypeptide
GSTSESPSGTAPGTSTPESGSASPGTSTPESGSASP

SEQ ID NO: 539 - DNA, 108 bp, Artificial Sequence
  Description of Artificial Sequence: Synthetic polynucleotide
ggttctactagcgaatccccgtctggtaccgcaccaggtacttctaccccggaaagcggctctgcttctccaggtacttctaccccggaaagcggctccgcatctcca

SEQ ID NO: 540 - protein, 36 aa, Artificial Sequence; identical to SEQ ID NO: 538
  Description of Artificial Sequence: Synthetic polypeptide

SEQ ID NO: 541 - DNA, 108 bp, Artificial Sequence
  Description of Artificial Sequence: Synthetic polynucleotide
ggttctactagcgaatccccgtctggtactgctccaggtacttctactcctgaaagcggttccgcttctccaggtacctctactccggaaagcggttctgcatctcca

SEQ ID NO: 542 - protein, 12 aa, Artificial Sequence
  Description of Artificial Sequence: Synthetic peptide
GTPGSGTASSSP

SEQ ID NO: 543 - protein, 12 aa, Artificial Sequence
  Description of Artificial Sequence: Synthetic peptide
GSSTPSGATGSP

SEQ ID NO: 544 - protein, 12 aa, Artificial Sequence
  Description of Artificial Sequence: Synthetic peptide
GSSPSASTGTGP

SEQ ID NO: 545 - protein, 12 aa, Artificial Sequence
  Description of Artificial Sequence: Synthetic peptide
GASPGTSSTGSP

SEQ ID NO: 546 - DNA, 36 bp, Artificial Sequence
  Description of Artificial Sequence: Synthetic oligonucleotide
aggtacycckggyagcggtacygcwtcttcytctcc

SEQ ID NO: 547 - DNA, 36 bp, Artificial Sequence
  Description of Artificial Sequence: Synthetic oligonucleotide
acctggagargaagawgcrgtaccgctrccmggrgt

SEQ ID NO: 548 - DNA, 36 bp, Artificial Sequence
  Description of Artificial Sequence: Synthetic oligonucleotide
aggtagctctacyccktctggtgcwacyggytcycc

SEQ ID NO: 549 - DNA, 36 bp, Artificial Sequence
  Description of Artificial Sequence: Synthetic oligonucleotide
acctggrgarccrgtwgcaccagamggrgtagagct

SEQ ID NO: 550 - DNA, 36 bp, Artificial Sequence
  Description of Artificial Sequence: Synthetic oligonucleotide
aggttctagcccktctgcwtcyacyggtacyggycc

SEQ ID NO: 551 - DNA, 36 bp, Artificial Sequence
  Description of Artificial Sequence: Synthetic oligonucleotide
acctggrccrgtaccrgtrgawgcagamgggctaga

SEQ ID NO: 552 - DNA, 36 bp, Artificial Sequence
  Description of Artificial Sequence: Synthetic oligonucleotide
aggtgcwtcycckggyacyagctctacyggttctcc

SEQ ID NO: 553 - DNA, 36 bp, Artificial Sequence
  Description of Artificial Sequence: Synthetic oligonucleotide
acctggagaaccrgtagagctrgtrccmggrgawgc

SEQ ID NO: 554 - DNA, 24 bp, Artificial Sequence
  Description of Artificial Sequence: Synthetic oligonucleotide
aggttcgtcttcactcgagggtac

SEQ ID NO: 555 - DNA, 16 bp, Artificial Sequence
  Description of Artificial Sequence: Synthetic oligonucleotide
cctcgagtgaagacga

SEQ ID NO: 556 - protein, 36 aa, Artificial Sequence
  Description of Artificial Sequence: Synthetic polypeptide
GASPGTSSTGSPGTPGSGTASSSPGSSTPSGATGSP

SEQ ID NO: 557 - DNA, 108 bp, Artificial Sequence
  Description of Artificial Sequence: Synthetic polynucleotide
ggtgcatccccgggcactagctctaccggttctccaggtactcctggtagcggtactgcttcttcttctccaggtagctctactccttctggtgctactggttctcca

SEQ ID NO: 558 - protein, 36 aa, Artificial Sequence
  Description of Artificial Sequence: Synthetic polypeptide
GSSTPSGATGSPGSSPSASTGTGPGSSTPSGATGSP

SEQ ID NO: 559 - DNA, 108 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctcca

SEQ ID NO: 560 - protein, 36 aa, Artificial Sequence
  Description of Artificial Sequence: Synthetic polypeptide
GASPGTSSTGSPGSSPSASTGTGPGSSTPSGATGSP

SEQ ID NO: 561 - DNA, 108 bp, Artificial Sequence
  Description of Artificial Sequence: Synthetic polynucleotide
ggtgcatctccgggtactagctctaccggttctccaggttctagcccttctgcttccactggtaccggcccaggtagctctaccccgtctggtgctactggttcccca

SEQ ID NO: 562 - protein, 36 aa, Artificial Sequence
  Description of Artificial Sequence: Synthetic polypeptide
GTPGSGTASSSPGSSTPSGATGSPGASPGTSSTGSP

SEQ ID NO: 563 - DNA, 108 bp, Artificial Sequence
  Description of Artificial Sequence: Synthetic polynucleotide
ggtactccgggcagcggtactgcttcttcctctccaggtagctctaccccttctggtgcaactggttccccaggtgcatcccctggtactagctctaccggttctcca

SEQ ID NO: 564 - protein, 36 aa, Artificial Sequence
  Description of Artificial Sequence: Synthetic polypeptide
GTPGSGTASSSPGASPGTSSTGSPGSRPSASTGTGP

SEQ ID NO: 565 - DNA, 108 bp, Artificial Sequence
  Description of Artificial Sequence: Synthetic polynucleotide
ggtacccctggcagcggtactgcttcttcttctccaggtgcttcccctggtaccagctctaccggttctccaggttctagaccttctgcatccaccggtactggtcca

SEQ ID NO: 566 - protein, 36 aa, Artificial Sequence
  Description of Artificial Sequence: Synthetic polypeptide
GASPGTSSTGSPGSSTPSGATGSPGASPGTSSTGSP

SEQ ID NO: 567 - DNA, 108 bp, Artificial Sequence
  Description of Artificial Sequence: Synthetic polynucleotide
ggtgcatctcctggtaccagctctaccggttctccaggtagctctactccttctggtgctactggctctccaggtgcttccccgggtaccagctctaccggttctcca

SEQ ID NO: 568 - protein, 36 aa, Artificial Sequence
  Description of Artificial Sequence: Synthetic polypeptide
GTPGSGTASSSPGSSTPSGATGSPGSSTPSGATGSP

SEQ ID NO: 569 - DNA, 108 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctcccca

SEQ ID NO: 570 - protein, 36 aa, Artificial Sequence
  Description of Artificial Sequence: Synthetic polypeptide
GASPGTSSTGSPGASPGTSSTGSPGASPGTSSTGSP

SEQ ID NO: 571 - DNA, 108 bp, Artificial Sequence
  Description of Artificial Sequence: Synthetic polynucleotide
ggtgcatctccgggcactagctctactggttctccaggtgcatcccctggcactagctctactggttctccaggtgcttctcctggtaccagctctactggttctcca

SEQ ID NO: 572 - protein, 36 aa, Artificial Sequence
  Description of Artificial Sequence: Synthetic polypeptide
GSSTPSGATGSPGSSPSASTGTGPGASPGTSSTGSP

SEQ ID NO: 573 - DNA, 108 bp, Artificial Sequence
  Description of Artificial Sequence: Synthetic polynucleotide
ggtagctctactccgtctggtgcaaccggctccccaggttctagcccgtctgcttccactggtactggcccaggtgcttccccgggcaccagctctactggttctcca

SEQ ID NO: 574 - protein, 36 aa, Artificial Sequence
  Description of Artificial Sequence: Synthetic polypeptide
GSSTPSGATGSPGSSTPSGATGSPGTPGSGTASSSP

SEQ ID NO: 575 - DNA, 108 bp, Artificial Sequence
  Description of Artificial Sequence: Synthetic polynucleotide
ggtagctctactccttctggtgctaccggttccccaggtagctctactccttctggtgctactggttccccaggtactccgggcagcggtactgcttcttcctctcca

SEQ ID NO: 576 - protein, 36 aa, Artificial Sequence
  Description of Artificial Sequence: Synthetic polypeptide
GSSTPSGATGSPGSSTPSGATGSPGASPGTSSTGSP

SEQ ID NO: 577 - DNA, 108 bp, Artificial Sequence
  Description of Artificial Sequence: Synthetic polynucleotide
ggtagctctactccgtctggtgcaaccggttccccaggtagctctactccttctggtgctactggctccccaggtgcatcccctggcaccagctctaccggttctcca

SEQ ID NO: 578 - protein, 36 aa, Artificial Sequence
  Description of Artificial Sequence: Synthetic polypeptide
GTPGSGTASSSPGSSPSASTGTGPGSSTPSGATGSP

SEQ ID NO: 579 - DNA, 108 bp, Artificial Sequence
  Description of Artificial Sequence: Synthetic polynucleotide
ggtactcctggtagcggtaccgcatcttcctctccaggttctagcccttctgcatctaccggtaccggtccaggtagctctactccttctggtgctactggctctcca

SEQ ID NO: 580 - protein, 36 aa, Artificial Sequence
  Description of Artificial Sequence: Synthetic polypeptide
GASPGTSSTGSPGSSPSASTGTGPGTPGSGTASSSP

SEQ ID NO: 581 - DNA, 108 bp, Artificial Sequence
  Description of Artificial Sequence: Synthetic polynucleotide
ggtgcttccccgggcactagctctaccggttctccaggttctagcccttctgcatctactggtactggcccaggtactccgggcagcggtactgcttcttcctctcca

SEQ ID NO: 582 - protein, 36 aa, Artificial Sequence; identical to SEQ ID NO: 576
  Description of Artificial Sequence: Synthetic polypeptide

SEQ ID NO: 583 - DNA, 108 bp, Artificial Sequence
  Description of Artificial Sequence: Synthetic polynucleotide
ggtagctctactccgtctggtgctaccggctctccaggtagctctaccccttctggtgcaaccggctccccaggtgcttctccgggtaccagctctactggttctcca

SEQ ID NO: 584 - protein, 36 aa, Artificial Sequence
  Description of Artificial Sequence: Synthetic polypeptide
GTPGSGTASSSPGSSTPSGATGSPGSSPSASTGTGP

SEQ ID NO: 585 - DNA, 108 bp, Artificial Sequence
  Description of Artificial Sequence: Synthetic polynucleotide
ggtacccctggcagcggtaccgcttcttcctctccaggtagctctaccccgtctggtgctactggctctccaggttctagcccgtctgcatctaccggtaccggccca

SEQ ID NO: 586 - protein, 36 aa, Artificial Sequence
  Description of Artificial Sequence: Synthetic polypeptide
GSSTPSGATGSPGTPGSGTASSSPGTPGSGTASSSP

SEQ ID NO: 587 - DNA, 108 bp, Artificial Sequence
  Description of Artificial Sequence: Synthetic polynucleotide
ggtagctctactccttctggtgcaaccggctccccaggtaccccgggcagcggtaccgcatcttcctctccaggtactccgggtagcggtactgcttcttcttctcca

SEQ ID NO: 588 - protein, 36 aa, Artificial Sequence; identical to SEQ ID NO: 562
  Description of Artificial Sequence: Synthetic polypeptide

SEQ ID NO: 589 - DNA, 108 bp, Artificial Sequence
  Description of Artificial Sequence: Synthetic polynucleotide
ggtaccccgggtagcggtactgcttcttcctctccaggtagctctaccccttctggtgcaaccggctctccaggtgcttctccgggcaccagctctaccggttctcca

SEQ ID NO: 590 - protein, 36 aa, Artificial Sequence; identical to SEQ ID NO: 576
  Description of Artificial Sequence: Synthetic polypeptide

SEQ ID NO: 591 - DNA, 108 bp, Artificial Sequence
  Description of Artificial Sequence: Synthetic polynucleotide
ggtagctctaccccgtctggtgctaccggctctccaggtagctctaccccgtctggtgcaaccggctccccaggtgcatccccgggtactagctctaccggttctcca

SEQ ID NO: 592 - protein, 36 aa, Artificial Sequence; identical to SEQ ID NO: 556
  Description of Artificial Sequence: Synthetic polypeptide

SEQ ID NO: 593 - DNA, 108 bp, Artificial Sequence
  Description of Artificial Sequence: Synthetic polynucleotide
ggtgcttctccgggcaccagctctactggttctccaggtaccccgggcagcggtaccgcatcttcttctccaggtagctctactccttctggtgcaactggttctcca

SEQ ID NO: 594 - protein, 36 aa, Artificial Sequence
  Description of Artificial Sequence: Synthetic polypeptide
GSSPSASTGTGPGSSTPSGATGSPGTPGSGTASSSP

SEQ ID NO: 595 - DNA, 108 bp, Artificial Sequence
  Description of Artificial Sequence: Synthetic polynucleotide
ggttctagcccgtctgcttccaccggtactggcccaggtagctctaccccgtctggtgcaactggttccccaggtacccctggtagcggtaccgcttcttcttctcca

SEQ ID NO: 596 - protein, 36 aa, Artificial Sequence; identical to SEQ ID NO: 560
  Description of Artificial Sequence: Synthetic polypeptide

SEQ ID NO: 597 - DNA, 108 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctcca

SEQ ID NO: 598 - protein, 36 aa, Artificial Sequence
  Description of Artificial Sequence: Synthetic polypeptide
GASPGTSSTGSPGSSTPSGATGSPGSSTPSGATGSP

SEQ ID NO: 599 - DNA, 108 bp, Artificial Sequence
  Description of Artificial Sequence: Synthetic polynucleotide
ggtgcatccccgggcaccagctctaccggttctccaggtagctctaccccgtctggtgctaccggctctccaggtagctctaccccgtctggtgctactggctctcca

SEQ ID NO: 600 - protein, 36 aa, Artificial Sequence
  Description of Artificial Sequence: Synthetic polypeptide
GTPGSGTASSSPGSSTPSGATGSPGTPGSGTASSSP

SEQ ID NO: 601 - DNA, 108 bp, Artificial Sequence
  Description of Artificial Sequence: Synthetic polynucleotide
ggtacccctggtagcggtactgcttcttcctctccaggtagctctactccgtctggtgctaccggttctccaggtaccccgggtagcggtaccgcatcttcttctcca

SEQ ID NO: 602 - protein, 36 aa, Artificial Sequence; identical to SEQ ID NO: 488
  Description of Artificial Sequence: Synthetic polypeptide

SEQ ID NO: 603 - DNA, 108 bp, Artificial Sequence
  Description of Artificial Sequence: Synthetic polynucleotide
ggttctagcccttctgcttccaccggtactggcccaggtagctctaccccttctggtgctaccggctccccaggtagctctactccttctggtgcaactggctctcca

SEQ ID NO: 604 - protein, 36 aa, Artificial Sequence
  Description of Artificial Sequence: Synthetic polypeptide
GASPGTSSTGSPGSSPSASTGTGPGSSPSASTGTGP

SEQ ID NO: 605 - DNA, 108 bp, Artificial Sequence
  Description of Artificial Sequence: Synthetic polynucleotide
ggtgcttctcctggcaccagctctactggttctccaggttctagcccttctgcttctaccggtactggtccaggttctagcccttctgcatccactggtactggtcca

SEQ ID NO: 606 - protein, 36 aa, Artificial Sequence
  Description of Artificial Sequence: Synthetic polypeptide
GTPGSGTASSSPGASPGTSSTGSPGASPGTSSTGSP

SEQ ID NO: 607 - DNA, 108 bp, Artificial Sequence
  Description of Artificial Sequence: Synthetic polynucleotide
ggtactcctggcagcggtaccgcttcttcttctccaggtgcttctcctggtactagctctactggttctccaggtgcttctccgggcactagctctactggttctcca

SEQ ID NO: 608 - protein, 36 aa, Artificial Sequence
  Description of Artificial Sequence: Synthetic polypeptide
GSSTPSGATGSPGASPGTSSTGSPGSSTPSGATGSP

SEQ ID NO: 609 - DNA, 108 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctcca

SEQ ID NO: 610 - protein, 36 aa, Artificial Sequence
  Description of Artificial Sequence: Synthetic polypeptide
GSSTPSGATGSPGTPGSGTASSSPGSSTPSGATGSP

SEQ ID NO: 611 - DNA, 108 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctcca

SEQ ID NO: 612 - protein, 36 aa, Artificial Sequence; identical to SEQ ID NO: 560
  Description of Artificial Sequence: Synthetic polypeptide

SEQ ID NO: 613 - DNA, 108 bp, Artificial Sequence
  Description of Artificial Sequence: Synthetic polynucleotide
ggtgcatctcctggtaccagctctactggttctccaggttctagcccttctgcttctaccggtaccggtccaggtagctctactccttctggtgctaccggttctcca

SEQ ID NO: 614 - protein, 36 aa, Artificial Sequence
  Description of Artificial Sequence: Synthetic polypeptide
GSSTPSGATGSPGSSTPSGATGSPGSSTPSGATGSP

SEQ ID NO: 615 - DNA, 108 bp, Artificial Sequence
  Description of Artificial Sequence: Synthetic polynucleotide
ggtagctctaccccgtctggtgctactggctctccaggtagctctactccttctggtgctactggttccccaggtagctctaccccgtctggtgcaactggctctcca

SEQ ID NO: 616 - protein, 36 aa, Artificial Sequence
  Description of Artificial Sequence: Synthetic polypeptide
GASPGTSSTGSPGTPGSGTASSSPGASPGTSSTGSP

SEQ ID NO: 617 - DNA, 108 bp, Artificial Sequence
  Description of Artificial Sequence: Synthetic polynucleotide
ggtgcatccccgggtaccagctctaccggttctccaggtactcctggcagcggtactgcatcttcctctccaggtgcttctccgggcaccagctctactggttctcca

SEQ ID NO: 618 - protein, 36 aa, Artificial Sequence; identical to SEQ ID NO: 572
  Description of Artificial Sequence: Synthetic polypeptide

SEQ ID NO: 619 - DNA, 108 bp, Artificial Sequence
  Description of Artificial Sequence: Synthetic polynucleotide
ggtagctctactccttctggtgcaactggttctccaggttctagcccgtctgcatccactggtaccggtccaggtgcttcccctggcaccagctctaccggttctcca

SEQ ID NO: 620 - protein, 36 aa, Artificial Sequence
  Description of Artificial Sequence: Synthetic polypeptide
GASPGTSSTGSPGSSTPSGATGSPGSSPSASTGTGP

SEQ ID NO: 621 - DNA, 108 bp, Artificial Sequence
  Description of Artificial Sequence: Synthetic polynucleotide
ggtgcatctcctggtactagctctactggttctccaggtagctctactccgtctggtgcaaccggctctccaggttctagcccttctgcatctaccggtactggtcca

SEQ ID NO: 622 - protein, 36 aa, Artificial Sequence; identical to SEQ ID NO: 562
  Description of Artificial Sequence: Synthetic polypeptide

SEQ ID NO: 623 - DNA, 108 bp, Artificial Sequence
  Description of Artificial Sequence: Synthetic polynucleotide
ggtactcctggcagcggtaccgcatcttcctctccaggtagctctactccgtctggtgcaactggttccccaggtgcttctccgggtaccagctctaccggttctcca

SEQ ID NO: 624 - protein, 36 aa, Artificial Sequence; identical to SEQ ID NO: 610
  Description of Artificial Sequence: Synthetic polypeptide

SEQ ID NO: 625 - DNA, 108 bp, Artificial Sequence
  Description of Artificial Sequence: Synthetic polynucleotide
ggtagctctaccccgtctggtgcaaccggctccccaggtactcctggtagcggtaccgcttcttcttctccaggtagctctactccgtctggtgctaccggctcccca

SEQ ID NO: 626 - protein, 36 aa, Artificial Sequence
  Description of Artificial Sequence: Synthetic polypeptide
GSSPSASTGTGPGSSPSASTGTGPGASPGTSSTGSP

SEQ ID NO: 627 - DNA, 108 bp, Artificial Sequence
  Description of Artificial Sequence: Synthetic polynucleotide
ggttctagcccttctgcatccaccggtaccggcccaggttctagcccgtctgcttctaccggtactggtccaggtgcttctccgggtactagctctactggttctcca

SEQ ID NO: 628 - protein, 36 aa, Artificial Sequence
  Description of Artificial Sequence: Synthetic polypeptide
GTPGSGTASSSPGSSTPSGATGSPGSNPSASTGTGP

SEQ ID NO: 629 - DNA, 108 bp, Artificial Sequence
  Description of Artificial Sequence: Synthetic polynucleotide
ggtaccccgggtagcggtaccgcttcttcttctccaggtagctctactccgtctggtgctaccggctctccaggttctaacccttctgcatccaccggtaccggccca

SEQ ID NO: 630 - protein, 36 aa, Artificial Sequence
  Description of Artificial Sequence: Synthetic polypeptide
GSSPSASTGTGPGSSTPSGATGSPGASPGTSSTGSP

SEQ ID NO: 631 - DNA, 108 bp, Artificial Sequence
  Description of Artificial Sequence: Synthetic polynucleotide
ggttctagcccttctgcatctactggtactggcccaggtagctctactccttctggtgctaccggctctccaggtgcttctccgggtactagctctaccggttctcca

SEQ ID NO: 632 - protein, 36 aa, Artificial Sequence
  Description of Artificial Sequence: Synthetic polypeptide
GSSTPSGATGSPGASPGTSSTGSPGTPGSGTASSSP

SEQ ID NO: 633 - DNA, 108 bp, Artificial Sequence
  Description of Artificial Sequence: Synthetic polynucleotide
ggtagctctaccccttctggtgcaaccggctctccaggtgcatccccgggtaccagctctaccggttctccaggtactccgggtagcggtaccgcttcttcctctcca

SEQ ID NO: 634 - protein, 36 aa, Artificial Sequence; identical to SEQ ID NO: 614
  Description of Artificial Sequence: Synthetic polypeptide

SEQ ID NO: 635 - DNA, 108 bp, Artificial Sequence
  Description of Artificial Sequence: Synthetic polynucleotide
ggtagctctactccgtctggtgcaaccggttccccaggtagctctaccccttctggtgcaaccggctccccaggtagctctaccccttctggtgcaactggctctcca

SEQ ID NO: 636 - protein, 36 aa, Artificial Sequence; identical to SEQ ID NO: 556
  Description of Artificial Sequence: Synthetic polypeptide

SEQ ID NO: 637 - DNA, 108 bp, Artificial Sequence
  Description of Artificial Sequence: Synthetic polynucleotide
ggtgcttctcctggcactagctctaccggttctccaggtacccctggtagcggtaccgcatcttcctctccaggtagctctactccttctggtgctactggttcccca

SEQ ID NO: 638 - protein, 36 aa, Artificial Sequence
  Description of Artificial Sequence: Synthetic polypeptide
GSSTPSGATGSPGSSPSASTGTGPGSSPSASTGTGP

SEQ ID NO: 639 - DNA, 108 bp, Artificial Sequence
  Description of Artificial Sequence: Synthetic polynucleotide
ggtagctctaccccgtctggtgctactggctccccaggttctagcccttctgcatccaccggtaccggtccaggttctagcccgtctgcatctactggtactggtcca

SEQ ID NO: 640 - protein, 36 aa, Artificial Sequence; identical to SEQ ID NO: 604
  Description of Artificial Sequence: Synthetic polypeptide

SEQ ID NO: 641 - DNA, 108 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtcca

SEQ ID NO: 642 - protein, 36 aa, Artificial Sequence; identical to SEQ ID NO: 580
  Description of Artificial Sequence: Synthetic polypeptide

SEQ ID NO: 643 - DNA, 108 bp, Artificial Sequence
  Description of Artificial Sequence: Synthetic polynucleotide
ggtgcttccccgggtaccagctctaccggttctccaggttctagcccttctgcttctaccggtaccggtccaggtacccctggcagcggtaccgcatcttcctctcca

SEQ ID NO: 644 - DNA, 432 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctccccaggtagcccggctggctctcctacctctactgaggaaggtacttctgaaagcgctactcctgagtctggtccaggtacctctactgaaccgtccgaaggtagcgctccaggttctagcccttctgcatccaccggtaccggcccaggttctagcccgtctgcttctaccggtactggtccaggtgcttctccgggtactagctctactggttctccaggtacctctaccgaaccgtccgagggtagcgcaccaggtacctctactgaaccgtctgagggtagcgctccaggtagcgaaccggcaacctccggttctgaaactcca

SEQ ID NO: 645 - protein, 144 aa, Artificial Sequence
  Description of Artificial Sequence: Synthetic polypeptide
GTPGSGTASSSPGSSTPSGATGSPGSSTPSGATGSPGSPAGSPTSTEEGTSESATPESGPGTSTEPSEGSAPGSSPSASTGTGPGSSPSASTGTGPGASPGTSSTGSPGTSTEPSEGSAPGTSTEPSEGSAPGSEPATSGSETP

SEQ ID NO: 646 - DNA, 432 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggttctactagcgaatctccttctggcactgcaccaggttctaccagcgaatctccgtctggcactgcaccaggtacctctacccctgaaagcggttccgcttctcca

SEQ ID NO: 647 - protein, 144 aa, Artificial Sequence
  Description of Artificial Sequence: Synthetic polypeptide
GSTSESPSGTAPGSTSESPSGTAPGTSPSGESSTAPGTSTEPSEGSAPGTSTEPSEGSAPGTSESATPESGPGASPGTSSTGSPGSSTPSGATGSPGASPGTSSTGSPGSTSESPSGTAPGSTSESPSGTAPGTSTPESGSASP

SEQ ID NO: 648 - DNA, 432 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtccaggtacctctactgaaccttctgagggcagcgctccaggtacttctgaaagcgctaccccggagtccggtccaggtacttctactgaaccgtccgaaggtagcgcaccaggtacttctactgaaccttccgaaggtagcgctccaggtagcgaacctgctacttctggttctgaaaccccaggtagcccggctggctctccgacctccaccgaggaaggtgcttctcctggcaccagctctactggttctccaggttctagcccttctgcttctaccggtactggtccaggttctagcccttctgcatccactggtactggtcca

SEQ ID NO: 649 - protein, 144 aa, Artificial Sequence
  Description of Artificial Sequence: Synthetic polypeptide
GTSTEPSEGSAPGTSESATPESGPGTSESATPESGPGTSTEPSEGSAPGTSESATPESGPGTSTEPSEGSAPGTSTEPSEGSAPGSEPATSGSETPGSPAGSPTSTEEGASPGTSSTGSPGSSPSASTGTGPGSSPSASTGTGP

SEQ ID NO: 650 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggttctaccagcgaatctccttctggcaccgctccaggttctactagcgaatccccgtctggtaccgcaccaggtacttctcctagcggcgaatcttctaccgcaccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 651 - protein, 144 aa, Artificial Sequence
  Description of Artificial Sequence: Synthetic polypeptide
GSEPATSGSETPGTSESATPESGPGTSESATPESGPGSTSESPSGTAPGSTSESPSGTAPGTSPSGESSTAPGASPGTSSTGSPGSSPSASTGTGPGSSTPSGATGSPGSSTPSGATGSPGSSTPSGATGSPGASPGTSSTGSP

SEQ ID NO: 652 - DNA, 432 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctccaggtacttctgaaagcgctaccccggaatctggcccaggtagcgaaccggctacttctggttctgaaaccccaggtagcgaaccggctacctccggttctgaaactccaggtacttctgaaagcgctactccggagtccggtccaggtacctctaccgaaccgtccgaaggcagcgctccaggtacttctactgaaccttctgagggtagcgctccaggtacctctaccgaaccgtccgagggtagcgcaccaggtacctctactgaaccgtctgagggtagcgctccaggtagcgaaccggcaacctccggttctgaaactcca

SEQ ID NO: 653 - protein, 144 aa, Artificial Sequence
  Description of Artificial Sequence: Synthetic polypeptide
GASPGTSSTGSPGSSPSASTGTGPGSSTPSGATGSPGTSESATPESGPGSEPATSGSETPGSEPATSGSETPGTSESATPESGPGTSTEPSEGSAPGTSTEPSEGSAPGTSTEPSEGSAPGTSTEPSEGSAPGSEPATSGSETP

SEQ ID NO: 654 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctctgaaagcgcaactcctgagtctggcccaggtagcgaacctgctacctccggctctgagactccaggtacctctgaaagcgcaaccccggaatctggtccaggtagcccggctggctctcctacctctactgaggaaggtacttctgaaagcgctactcctgagtctggtccaggtacctctactgaaccgtccgaaggtagcgctccaggtagcgaacctgctacttctggttctgaaactccaggtacttctaccgaaccgtccgagggtagcgctccaggtagcgaacctgctacttctggttctgaaactcca

SEQ ID NO: 655 - protein, 144 aa, Artificial Sequence
  Description of Artificial Sequence: Synthetic polypeptide
GTSTEPSEGSAPGSPAGSPTSTEEGTSTEPSEGSAPGTSESATPESGPGSEPATSGSETPGTSESATPESGPGSPAGSPTSTEEGTSESATPESGPGTSTEPSEGSAPGSEPATSGSETPGTSTEPSEGSAPGSEPATSGSETP

SEQ ID NO: 656 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccttccgagggcagcgcaccaggtacttctgaaagcgctacccctgagtccggcccaggtacttctgaaagcgctactcctgaatccggtccaggtacttctactgaaccttccgaaggtagcgctccaggtagcgaacctgctacttctggttctgaaaccccaggtagcccggctggctctccgacctccaccgaggaa

SEQ ID NO: 657 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSTEPSEGSAPGTSTEPSEGSAPGTSTEPSEGSAPGTSESATPESGPGTSESATPESGPGTSTEPSEGSAPGSEPATSGSETPGSPAGSPTSTEE

SEQ ID NO: 658 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcaccaggtacttctactgaaccgtctgaaggtagcgcaccaggtacttctgaaagcgcaaccccggaatccggcccaggtacctctgaaagcgcaaccccggagtccggccca

SEQ ID NO: 659 - protein, 144 aa, Artificial Sequence
  Description of Artificial Sequence: Synthetic polypeptide
GTSTEPSEGSAPGTSTEPSEGSAPGTSTEPSEGSAPGSTSESPSGTAPGSTSESPSGTAPGTSTPESGSASPGSEPATSGSETPGTSESATPESGPGTSTEPSEGSAPGTSTEPSEGSAPGTSESATPESGPGTSESATPESGP

SEQ ID NO: 660 - DNA, 432 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctccaggtagccctgctggctctccgacttctactgaggaaggtagcccggctggttctccgacttctactgaggaaggtacttctaccgaaccttccgaaggtagcgctccaggtgcttccccgggcactagctctaccggttctccaggttctagcccttctgcatctactggtactggcccaggtactccgggcagcggtactgcttcttcctctccaggttctactagctctactgctgaatctcctggcccaggtacttctcctagcggtgaatcttctaccgctccaggtacctctactccggaaagcggttctgcatctcca

SEQ ID NO: 661 - protein, 144 aa, Artificial Sequence
  Description of Artificial Sequence: Synthetic polypeptide
GSSTPSGATGSPGSSPSASTGTGPGSSTPSGATGSPGSPAGSPTSTEEGSPAGSPTSTEEGTSTEPSEGSAPGASPGTSSTGSPGSSPSASTGTGPGTPGSGTASSSPGSTSSTAESPGPGTSPSGESSTAPGTSTPESGSASP

SEQ ID NO: 662 - DNA, 432 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtactcctggcagcggtaccgcttcttcttctccaggtgcttctcctggtactagctctactggttctccaggtgcttctccgggcactagctctactggttctccaggtagccctgctggctctccgacttctactgaggaaggtagcccggctggttctccgacttctactgaggaaggtacttctaccgaaccttccgaaggtagcgctcca

SEQ ID NO: 663 - protein, 144 aa, Artificial Sequence
  Description of Artificial Sequence: Synthetic polypeptide
GTSTEPSEGSAPGTSESATPESGPGTSTEPSEGSAPGTSTEPSEGSAPGTSESATPESGPGTSESATPESGPGTPGSGTASSSPGASPGTSSTGSPGASPGTSSTGSPGSPAGSPTSTEEGSPAGSPTSTEEGTSTEPSEGSAP

SEQ ID NO: 664 - DNA, 432 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctccaggtacctctaccgaaccgtctgaaggtagcgcaccaggtacctctgaaagcgcaactcctgagtccggtccaggtacttctgaaagcgcaaccccggagtctggcccaggtaccccgggtagcggtactgcttcttcctctccaggtagctctaccccttctggtgcaaccggctctccaggtgcttctccgggcaccagctctaccggttctccaggtacctctactgaaccttctgagggcagcgctccaggtacttctgaaagcgctaccccggagtccggtccaggtacttctactgaaccgtccgaaggtagcgcacca

SEQ ID NO: 665 - protein, 144 aa, Artificial Sequence
  Description of Artificial Sequence: Synthetic polypeptide
GSPAGSPTSTEEGTSTEPSEGSAPGTSTEPSEGSAPGTSTEPSEGSAPGTSESATPESGPGTSESATPESGPGTPGSGTASSSPGSSTPSGATGSPGASPGTSSTGSPGTSTEPSEGSAPGTSESATPESGPGTSTEPSEGSAP

SEQ ID NO: 666 - DNA, 432 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaaccccaggtagctctaccccgtctggtgcaaccggctccccaggtactcctggtagcggtaccgcttcttcttctccaggtagctctactccgtctggtgctaccggctccccaggtgcatctcctggtaccagctctaccggttctccaggtagctctactccttctggtgctactggctctccaggtgcttccccgggtaccagctctaccggttctccaggtagcgaacctgctacttctggttctgaaactccaggtacttctaccgaaccgtccgagggtagcgctccaggtagcgaacctgctacttctggttctgaaactcca

SEQ ID NO: 667 - protein, 144 aa, Artificial Sequence
  Description of Artificial Sequence: Synthetic polypeptide
GSEPATSGSETPGTSESATPESGPGSEPATSGSETPGSSTPSGATGSPGTPGSGTASSSPGSSTPSGATGSPGASPGTSSTGSPGSSTPSGATGSPGASPGTSSTGSPGSEPATSGSETPGTSTEPSEGSAPGSEPATSGSETP

SEQ ID NO: 668 - DNA, 432 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtccaggtagccctgctggctctccgacttctactgaggaaggtagcccggctggttctccgacttctactgaggaaggtacttctaccgaaccttccgaaggtagcgctccaggtagcccggctggttctccgacttccaccgaggaaggtacctctactgaaccttctgagggtagcgctccaggtacctctactgaaccttccgaaggcagcgctccaggtgcttccccgggcaccagctctactggttctccaggttctagcccgtctgcttctactggtactggtccaggttctagcccttctgcttccactggtactggtcca

SEQ ID NO: 669 - protein, 144 aa, Artificial Sequence
  Description of Artificial Sequence: Synthetic polypeptide
GTSTEPSEGSAPGTSTEPSEGSAPGTSESATPESGPGSPAGSPTSTEEGSPAGSPTSTEEGTSTEPSEGSAPGSPAGSPTSTEEGTSTEPSEGSAPGTSTEPSEGSAPGASPGTSSTGSPGSSPSASTGTGPGSSPSASTGTGP

SEQ ID NO: 670 - DNA, 432 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctccaggtagccctgctggctctccaacctccaccgaagaaggtacctctgaaagcgcaacccctgaatccggcccaggtagcgaaccggcaacctccggttctgaaaccccaggtgcatctcctggtactagctctactggttctccaggtagctctactccgtctggtgcaaccggctctccaggttctagcccttctgcatctaccggtactggtccaggttctaccagcgaatccccttctggtactgctccaggttctaccagcgaatccccttctggcaccgcaccaggtacttctacccctgaaagcggctccgcttctcca

SEQ ID NO: 671 - protein, 144 aa, Artificial Sequence
  Description of Artificial Sequence: Synthetic polypeptide
GSSTPSGATGSPGASPGTSSTGSPGSSTPSGATGSPGSPAGSPTSTEEGTSESATPESGPGSEPATSGSETPGASPGTSSTGSPGSSTPSGATGSPGSSPSASTGTGPGSTSESPSGTAPGSTSESPSGTAPGTSTPESGSASP

SEQ ID NO: 672 - DNA, 432 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcaccaggtacctctgaaagcgctactccggagtctggcccaggtacctctactgaaccgtctgagggtagcgctccaggtacttctactgaaccgtccgaaggtagcgcaccaggtacctctactgaaccttctgagggcagcgctccaggtacttctgaaagcgctaccccggagtccggtccaggtacttctactgaaccgtccgaaggtagcgcaccaggtagctctaccccgtctggtgctaccggttccccaggtgcttctcctggtactagctctaccggttctccaggtagctctaccccgtctggtgctactggctctcca

SEQ ID NO: 673 - protein, 144 aa, Artificial Sequence
  Description of Artificial Sequence: Synthetic polypeptide
GSTSESPSGTAPGSTSESPSGTAPGTSPSGESSTAPGTSESATPESGPGTSTEPSEGSAPGTSTEPSEGSAPGTSTEPSEGSAPGTSESATPESGPGTSTEPSEGSAPGSSTPSGATGSPGASPGTSSTGSPGSSTPSGATGSP

SEQ ID NO: 674 - DNA, 432 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctccaggttctactagctctaccgctgaatctccgggtccaggttctaccagctctactgcagaatctcctggcccaggtacttctactccggaaagcggttccgcttctccaggtacttctcctagcggtgaatcttctaccgctccaggttctaccagctctactgctgaatctcctggcccaggtacttctaccccggaaagcggctccgcttctccaggttctaccagctctaccgctgaatctcctggcccaggttctactagcgaatctccgtctggcaccgcaccaggtacttcccctagcggtgaatcttctactgcacca

SEQ ID NO: 675 - protein, 144 aa, Artificial Sequence
  Description of Artificial Sequence: Synthetic polypeptide
GSTSSTAESPGPGTSPSGESSTAPGTSPSGESSTAPGSTSSTAESPGPGSTSSTAESPGPGTSTPESGSASPGTSPSGESSTAPGSTSSTAESPGPGTSTPESGSASPGSTSSTAESPGPGSTSESPSGTAPGTSPSGESSTAP

SEQ ID NO: 676 - DNA, 432 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggcccaggtacctctactgaaccttccgaaggcagcgctccaggtacctctaccgaaccgtccgagggcagcgcaccaggtacttctgaaagcgcaacccctgaatccggtccaggtacctctgaaagcgctactccggagtctggcccaggtacctctactgaaccgtctgagggtagcgctccaggtacttctactgaaccgtccgaaggtagcgcaccaggtacttctgaaagcgctactccggagtccggtccaggtacctctaccgaaccgtccgaaggcagcgctccaggtacttctactgaaccttctgagggtagcgctccc

SEQ ID NO: 677 - protein, 144 aa, Artificial Sequence
  Description of Artificial Sequence: Synthetic polypeptide
GTSTPESGSASPGSTSESPSGTAPGSTSSTAESPGPGTSTEPSEGSAPGTSTEPSEGSAPGTSESATPESGPGTSESATPESGPGTSTEPSEGSAPGTSTEPSEGSAPGTSESATPESGPGTSTEPSEGSAPGTSTEPSEGSAP

SEQ ID NO: 678 - DNA, 432 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactccaggtacttctactgaaccgtctgaaggtagcgcaccaggtacttctgaaagcgcaaccccggaatccggcccaggtacctctgaaagcgcaaccccggagtccggcccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 679 - protein, 144 aa, Artificial Sequence
  Description of Artificial Sequence: Synthetic polypeptide
GTSTEPSEGSAPGTSTEPSEGSAPGSEPATSGSETPGTSTEPSEGSAPGTSESATPESGPGTSESATPESGPGASPGTSSTGSPGSSPSASTGTGPGSSTPSGATGSPGSSTPSGATGSPGSSTPSGATGSPGASPGTSSTGSP

SEQ ID NO: 680 - DNA, 432 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcaccaggtagcgaacctgcaacctctggctctgaaaccccaggtacctctgaaagcgctactcctgaatctggcccaggtacttctactgaaccgtccgagggcagcgcaccaggtagctctactccgtctggtgctaccggctctccaggtagctctaccccttctggtgcaaccggctccccaggtgcttctccgggtaccagctctactggttctccaggtagctctaccccgtctggtgctaccggttccccaggtgcttctcctggtactagctctaccggttctccaggtagctctaccccgtctggtgctactggctctcca

SEQ ID NO: 681 - protein, 144 aa, Artificial Sequence
  Description of Artificial Sequence: Synthetic polypeptide
GSEPATSGSETPGSEPATSGSETPGTSTEPSEGSAPGSEPATSGSETPGTSESATPESGPGTSTEPSEGSAPGSSTPSGATGSPGSSTPSGATGSPGASPGTSSTGSPGSSTPSGATGSPGASPGTSSTGSPGSSTPSGATGSP

SEQ ID NO: 682 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacttctgaaagcgctactccggagtccggtccaggtacctctaccgaaccgtccgaaggcagcgctccaggtacttctactgaaccttctgagggtagcgctccaggttctactagcgaatctccgtctggcactgctccaggtacttctcctagcggtgaatcttctaccgctccaggtacttcccctagcggcgaatcttctaccgctccaggtagcccggctggctctcctacctctactgaggaaggtacttctgaaagcgctactcctgagtctggtccaggtacctctactgaaccgtccgaaggtagcgctcca

SEQ ID NO: 683 - protein, 144 aa, Artificial Sequence
  Description of Artificial Sequence: Synthetic polypeptide
GTSTEPSEGSAPGTSTEPSEGSAPGTSTEPSEGSAPGTSESATPESGPGTSTEPSEGSAPGTSTEPSEGSAPGSTSESPSGTAPGTSPSGESSTAPGTSPSGESSTAPGSPAGSPTSTEEGTSESATPESGPGTSTEPSEGSAP

SEQ ID NO: 684 - DNA, 432 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaaggtagcccggcaggctctccgacctctactgaggaaggtacttctgaaagcgcaaccccggagtccggcccaggtacctctaccgaaccgtctgagggcagcgcaccaggtacctctactgaaccttccgaaggcagcgctccaggtacctctaccgaaccgtccgagggcagcgcaccaggtacttctgaaagcgcaacccctgaatccggtccaggtagctctactccgtctggtgcaaccggctccccaggttctagcccgtctgcttccactggtactggcccaggtgcttccccgggcaccagctctactggttctcca

SEQ ID NO: 685 - protein, 144 aa, Artificial Sequence
  Description of Artificial Sequence: Synthetic polypeptide
GTSTEPSEGSAPGSEPATSGSETPGSPAGSPTSTEEGSPAGSPTSTEEGTSESATPESGPGTSTEPSEGSAPGTSTEPSEGSAPGTSTEPSEGSAPGTSESATPESGPGSSTPSGATGSPGSSPSASTGTGPGASPGTSSTGSP

SEQ ID NO: 686 - DNA, 432 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggcccaggtacctctactgaaccttccgaaggcagcgctccaggtacctctaccgaaccgtccgagggcagcgcaccaggtacttctgaaagcgcaacccctgaatccggtccaggtacctctactccggaaagcggttccgcatctccaggttctaccagcgaatccccgtctggcaccgcaccaggttctactagctctactgctgaatctccgggcccaggtacttctgaaagcgctactccggagtccggtccaggtacctctaccgaaccgtccgaaggcagcgctccaggtacttctactgaaccttctgagggtagcgctcca

SEQ ID NO: 687 - protein, 144 aa, Artificial Sequence
  Description of Artificial Sequence: Synthetic polypeptide
GSEPATSGSETPGSPAGSPTSTEEGTSESATPESGPGTSTEPSEGSAPGTSTEPSEGSAPGTSESATPESGPGTSTPESGSASPGSTSESPSGTAPGSTSSTAESPGPGTSESATPESGPGTSTEPSEGSAPGTSTEPSEGSAP

SEQ ID NO: 688 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacctctaccgaaccgtctgaaggtagcgcaccaggtacctctgaaagcgcaactcctgagtccggtccaggtacttctgaaagcgcaaccccggagtctggcccaggtactcctggcagcggtaccgcatcttcctctccaggtagctctactccgtctggtgcaactggttccccaggtgcttctccgggtaccagctctaccggttctccaggttccaccagctctactgctgaatctcctggtccaggtacctctcctagcggtgaatcttctactgctccaggtacttctactcctgaaagcggctctgcttctcca

SEQ ID NO: 689 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSESATPESGPGTSESATPESGPGTPGSGTASSSPGSSTPSGATGSPGASPGTSSTGSPGSTSSTAESPGPGTSPSGESSTAPGTSTPESGSASP

SEQ ID NO: 690 - DNA, 432 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcaccaggtacttctgaaagcgcaacccctgaatccggtccaggtagcgaaccggctacttctggctctgagactccaggtacttctaccgaaccgtccgaaggtagcgcaccaggtagcccggctggttctccgacttccaccgaggaaggtacctctactgaaccttctgagggtagcgctccaggtacctctactgaaccttccgaaggcagcgctccaggtacttctaccgaaccgtccgagggcagcgctccaggtacttctactgaaccttctgaaggcagcgctccaggtacttctactgaaccttccgaaggtagcgcacca

SEQ ID NO: 691 - protein, 144 aa, Artificial Sequence
  Description of Artificial Sequence: Synthetic polypeptide
GSPAGSPTSTEEGTSESATPESGPGTSTEPSEGSAPGTSESATPESGPGSEPATSGSETPGTSTEPSEGSAPGSPAGSPTSTEEGTSTEPSEGSAPGTSTEPSEGSAPGTSTEPSEGSAPGTSTEPSEGSAPGTSTEPSEGSAP

SEQ ID NO: 692 - DNA, 432 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctcca

SEQ ID NO: 693 - protein, 144 aa, Artificial Sequence
  Description of Artificial Sequence: Synthetic polypeptide
GTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAP

SEQ ID NO: 694 - DNA, 432 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcaccaggtagccctgctggctctccgacttctactgaggaaggtagcccggctggttctccgacttctactgaggaaggtacttctaccgaaccttccgaaggtagcgctccaggttctagcccttctgcttccaccggtactggcccaggtagctctaccccttctggtgctaccggctccccaggtagctctactccttctggtgcaactggctctccaggtagcgaaccggcaacttccggctctgaaaccccaggtacttctgaaagcgctactcctgagtctggcccaggtagcgaacctgctacctctggctctgaaacccca

SEQ ID NO: 695 - protein, 144 aa, Artificial Sequence
  Description of Artificial Sequence: Synthetic polypeptide
GTSESATPESGPGTSTEPSEGSAPGTSTEPSEGSAPGSPAGSPTSTEEGSPAGSPTSTEEGTSTEPSEGSAPGSSPSASTGTGPGSSTPSGATGSPGSSTPSGATGSPGSEPATSGSETPGTSESATPESGPGSEPATSGSETP

SEQ ID NO: 696 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtagctctaccccgtctggtgctaccggttccccaggtgcttctcctggtactagctctaccggttctccaggtagctctaccccgtctggtgctactggctctccaggtacttctgaaagcgcaacccctgaatccggtccaggtagcgaaccggctacttctggctctgagactccaggtacttctaccgaaccgtccgaaggtagcgcaccaggttctactagcgaatctccttctggcactgcaccaggttctaccagcgaatctccgtctggcactgcaccaggtacctctacccctgaaagcggttccgcttctcca

SEQ ID NO: 697 - protein, 144 aa, Artificial Sequence
  Description of Artificial Sequence: Synthetic polypeptide
GTSTEPSEGSAPGTSTEPSEGSAPGTSTEPSEGSAPGSSTPSGATGSPGASPGTSSTGSPGSSTPSGATGSPGTSESATPESGPGSEPATSGSETPGTSTEPSEGSAPGSTSESPSGTAPGSTSESPSGTAPGTSTPESGSASP

SEQ ID NO: 698 - DNA, 432 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggcccaggttctagcccttctgcatctactggtactggcccaggtagctctactccttctggtgctaccggctctccaggtgcttctccgggtactagctctaccggttctccaggtagcgaaccggcaacctccggctctgaaaccccaggtacctctgaaagcgctactcctgaatccggcccaggtagcccggcaggttctccgacttccactgaggaaggttctactagcgaatctccttctggcactgcaccaggttctaccagcgaatctccgtctggcactgcaccaggtacctctacccctgaaagcggttccgcttctccc

SEQ ID NO: 699 - protein, 144 aa, Artificial Sequence
  Description of Artificial Sequence: Synthetic polypeptide
GTSTPESGSASPGSTSSTAESPGPGSTSSTAESPGPGSSPSASTGTGPGSSTPSGATGSPGASPGTSSTGSPGSEPATSGSETPGTSESATPESGPGSPAGSPTSTEEGSTSESPSGTAPGSTSESPSGTAPGTSTPESGSASP

SEQ ID NO: 700 - DNA, 432 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggttctaccagcgaatctccttctggcaccgctccaggttctactagcgaatccccgtctggtaccgcaccaggtacttctcctagcggcgaatcttctaccgcaccaggtacctctaccgaaccttccgaaggtagcgctccaggtagcccggcaggttctcctacttccactgaggaaggtacttctaccgaaccttctgagggtagcgcaccaggtagcgaacctgcaacctctggctctgaaaccccaggtacctctgaaagcgctactcctgaatctggcccaggtacttctactgaaccgtccgagggcagcgcacca

SEQ ID NO: 701 - protein, 144 aa, Artificial Sequence
  Description of Artificial Sequence: Synthetic polypeptide
GSPAGSPTSTEEGTSESATPESGPGTSTEPSEGSAPGSTSESPSGTAPGSTSESPSGTAPGTSPSGESSTAPGTSTEPSEGSAPGSPAGSPTSTEEGTSTEPSEGSAPGSEPATSGSETPGTSESATPESGPGTSTEPSEGSAP

SEQ ID NO: 702 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctcccctagcggcgaatcttctactgctccaggtacctctcctagcggcgaatcttctaccgctccaggtacctcccctagcggtgaatcttctaccgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcacca

SEQ ID NO: 703 - protein, 144 aa, Artificial Sequence
  Description of Artificial Sequence: Synthetic polypeptide
GTSTEPSEGSAPGSPAGSPTSTEEGTSTEPSEGSAPGTSPSGESSTAPGTSPSGESSTAPGTSPSGESSTAPGSTSESPSGTAPGSTSESPSGTAPGTSTPESGSASPGSEPATSGSETPGTSESATPESGPGTSTEPSEGSAP

SEQ ID NO: 704 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggtacttctccgagcggtgaatcttctaccgcaccaggttctactagctctaccgctgaatctccgggcccaggtacttctccgagcggtgaatcttctactgctccaggttctactagcgaatccccgtctggtactgctccaggtacttcccctagcggtgaatcttctactgctccaggttctaccagctctaccgcagaatctccgggtccaggtagctctactccgtctggtgcaaccggttccccaggtagctctaccccttctggtgcaaccggctccccaggtagctctaccccttctggtgcaaactggctctcc

SEQ ID NO: 705 - protein, 144 aa, Artificial Sequence
  Description of Artificial Sequence: Synthetic polypeptide
GSEPATSGSETPGTSESATPESGPGTSESATPESGPGTSPSGESSTAPGSTSSTAESPGPGTSPSGESSTAPGSTSESPSGTAPGTSPSGESSTAPGSTSSTAESPGPGSSTPSGATGSPGSSTPSGATGSPGSSTPSGANWLS

SEQ ID NO: 706 - DNA, 432 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggtagctctaccccgtctggtgctactggttctccaggtactccgggcagcggtactgcttcttcctctccaggtagctctaccccttctggtgctactggctctcca

SEQ ID NO: 707 - protein, 144 aa, Artificial Sequence
  Description of Artificial Sequence: Synthetic polypeptide
GSPAGSPTSTEEGSPAGSPTSTEEGTSTEPSEGSAPGTSTEPSEGSAPGTSTEPSEGSAPGTSESATPESGPGASPGTSSTGSPGSSTPSGATGSPGASPGTSSTGSPGSSTPSGATGSPGTPGSGTASSSPGSSTPSGATGSP

SEQ ID NO: 708 - DNA, 432 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctccaggtagcccggctggctctcctacctctactgaggaaggtacttctgaaagcgctactcctgagtctggtccaggtacctctactgaaccgtccgaaggtagcgctccaggtacctctgaaagcgcaactcctgagtctggcccaggtagcgaacctgctacctccggctctgagactccaggtacctctgaaagcgcaaccccggaatctggtccaggtacttctactgaaccgtctgaaggtagcgcaccaggtacttctgaaagcgcaaccccggaatccggcccaggtacctctgaaagcgcaaccccggagtccggccca

SEQ ID NO: 709 - protein, 144 aa, Artificial Sequence
  Description of Artificial Sequence: Synthetic polypeptide
GSSTPSGATGSPGTPGSGTASSSPGSSTPSGATGSPGSPAGSPTSTEEGTSESATPESGPGTSTEPSEGSAPGTSESATPESGPGSEPATSGSETPGTSESATPESGPGTSTEPSEGSAPGTSESATPESGPGTSESATPESGP

SEQ ID NO: 710 - DNA, 57 bp, Artificial Sequence
  Description of Artificial Sequence: Synthetic oligonucleotide
aggtgcaagcgcaagcggcgcgccaagcacgggaggttcgtcttcactcgagggtac

SEQ ID NO: 711 - DNA, 49 bp, Artificial Sequence
  Description of Artificial Sequence: Synthetic oligonucleotide
cctcgagtgaagacgaacctcccgtgcttggcgcgccgcttgcgcttgc

SEQ ID NO: 712 - protein, 11 aa, Artificial Sequence
  Description of Artificial Sequence: Synthetic peptide
GASASGAPSTG

SEQ ID NO: 713 - DNA, 57 bp, Artificial Sequence
  Description of Artificial Sequence: Synthetic oligonucleotide
aggtccagaaccaacggggccggccccaagcggaggttcgtcttcactcgagggtac

SEQ ID NO: 714 - DNA, 49 bp, Artificial Sequence
  Description of Artificial Sequence: Synthetic oligonucleotide
cctcgagtgaagacgaacctccgcttggggccggccccgttggttctgg

SEQ ID NO: 715 - protein, 11 aa, Artificial Sequence
  Description of Artificial Sequence: Synthetic peptide
GPEPTGPAPSG

SEQ ID NO: 716 - protein, 13 aa, Artificial Sequence
  Description of Artificial Sequence: Synthetic peptide
MASPAGSPTSTEE

SEQ ID NO: 717 - protein, 13 aa, Artificial Sequence
  Description of Artificial Sequence: Synthetic peptide
MATSESATPESGP

SEQ ID NO: 718 - protein, 13 aa, Artificial Sequence
  Description of Artificial Sequence: Synthetic peptide
MATSPSGESSTAP

SEQ ID NO: 719 - protein, 13 aa, Artificial Sequence
  Description of Artificial Sequence: Synthetic peptide
MESTSSTAESPGP

SEQ ID NO: 720 - protein, 13 aa, Artificial Sequence
  Description of Artificial Sequence: Synthetic peptide
MASSTPSGATGSP

SEQ ID NO: 721 - protein, 13 aa, Artificial Sequence
  Description of Artificial Sequence: Synthetic peptide
MEASPGTSSTGSP

SEQ ID NO: 722 - protein, 11 aa, Artificial Sequence
  Description of Artificial Sequence: Synthetic peptide
MASTPESGSSG

SEQ ID NO: 723 - DNA, 51 bp, Artificial Sequence
  Description of Artificial Sequence: Synthetic oligonucleotide
atggctagtccggctggctctccgacctccactgaggaaggtacttctact

SEQ ID NO: 724 - DNA, 51 bp, Artificial Sequence
  Description of Artificial Sequence: Synthetic oligonucleotide
atggctagtcctgctggctctccaacctccactgaggaaggtacttctact

SEQ ID NO: 725 - DNA, 51 bp, Artificial Sequence
  Description of Artificial Sequence: Synthetic oligonucleotide
atggctagtccagcaggctctcctacctccaccgaggaaggtacttctact

SEQ ID NO: 726 - DNA, 51 bp, Artificial Sequence
  Description of Artificial Sequence: Synthetic oligonucleotide
atggctagtcctgctggctctccgacctctactgaggaaggtacttctact

SEQ ID NO: 727 - DNA, 51 bp, Artificial Sequence
  Description of Artificial Sequence: Synthetic oligonucleotide
atggctacatccgaaagcgcaacccctgagtccggtccaggtacttctact

SEQ ID NO: 728 - DNA, 51 bp, Artificial Sequence
  Description of Artificial Sequence: Synthetic oligonucleotide
atggctacatccgaaagcgcaacccctgaatctggtccaggtacttctact

SEQ ID NO: 729 - DNA, 51 bp, Artificial Sequence
  Description of Artificial Sequence: Synthetic oligonucleotide
atggctacgtctgaaagcgctactccggaatctggtccaggtacttctact

SEQ ID NO: 730 - DNA, 51 bp, Artificial Sequence
  Description of Artificial Sequence: Synthetic oligonucleotide
atggctacgtccgaaagcgctacccctgaatccggtccaggtacttctact

SEQ ID NO: 731 - DNA, 51 bp, Artificial Sequence
  Description of Artificial Sequence: Synthetic oligonucleotide
atggctagttctaccccgtctggtgcaaccggttccccaggtacttctact

SEQ ID NO: 732 - DNA, 51 bp, Artificial Sequence
  Description of Artificial Sequence: Synthetic oligonucleotide
atggctagctccactccgtctggtgctaccggttccccaggtacttctact

SEQ ID NO: 733 - DNA, 51 bp, Artificial Sequence
  Description of Artificial Sequence: Synthetic oligonucleotide
atggctagctctactccgtctggtgctactggttccccaggtacttctact

SEQ ID NO: 734 - DNA, 51 bp, Artificial Sequence
  Description of Artificial Sequence: Synthetic oligonucleotide
atggctagttctaccccttctggtgctactggttctccaggtacttctact

SEQ ID NO: 735 - DNA, 180 bp, Artificial Sequence
  Description of Artificial Sequence: Synthetic polynucleotide
atggctagtcctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 736 - DNA, 180 bp, Artificial Sequence; identical to SEQ ID NO: 735
  Description of Artificial Sequence: Synthetic polynucleotide

SEQ ID NO: 737 - DNA, 180 bp, Artificial Sequence
  Description of Artificial Sequence: Synthetic polynucleotide
atggctagtcctgctggctctccaacctccactgaggaaggtacttctaccgaaccgtccgagggtagcgcaccaggtagcccagcaggttctcctacctccaccgaggaaggtacttctaccgaaccgtccgagggtagcgcaccaggtacttctactgaaccgtctgaaggcagcgca

SEQ ID NO: 738 - DNA, 180 bp, Artificial Sequence
  Description of Artificial Sequence: Synthetic polynucleotide
atggctagtcctgctggctctccgacctctactgaggaaggtacttctactgaaccgtctgaaggcagcgcaccaggtagcgaaccggctacttccggttctgaaaccccaggtagcccagcaggttctccaacttctactgaagaaggtacttctactgaaccgtctgaaggcagcgca

SEQ ID NO: 739 - DNA, 180 bp, Artificial Sequence
  Description of Artificial Sequence: Synthetic polynucleotide
atggctagtcctgctggctctccaacctccactgaggaaggtaccccgggtagcggtactgcttcttcctctccaggtagctctaccccttctggtgcaaccggctctccaggtgcttctccgggcaccagctctaccggttctccaggtacttctactgaaccgtctgaaggcagcgca

SEQ ID NO: 740 - DNA, 180 bp, Artificial Sequence; identical to SEQ ID NO: 738
  Description of Artificial Sequence: Synthetic polynucleotide

SEQ ID NO: 741 - DNA, 180 bp, Artificial Sequence
  Description of Artificial Sequence: Synthetic polynucleotide
atggctagtcctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 742 - DNA, 180 bp, Artificial Sequence
  Description of Artificial Sequence: Synthetic polynucleotide
atggctagtcctgctggctctccgacctctactgaggaaggtacctctactccggaaagcggttccgcatctccaggttctaccagcgaatccccgtctggcaccgcaccaggttctactagctctactgctgaatctccgggcccaggtacttctactgaaccgtctgaaggcagcgca

SEQ ID NO: 743 - DNA, 180 bp, Artificial Sequence; identical to SEQ ID NO: 741
  Description of Artificial Sequence: Synthetic polynucleotide

SEQ ID NO: 744 - DNA, 180 bp, Artificial Sequence; identical to SEQ ID NO: 742
  Description of Artificial Sequence: Synthetic polynucleotide

SEQ ID NO: 745 - DNA, 180 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 746 - DNA, 180 bp, Artificial Sequence
  Description of Artificial Sequence: Synthetic polynucleotide
atggctgaacctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 747 - DNA, 180 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgag

SEQ ID NO: 748 - DNA, 180 bp, Artificial Sequence
  Description of Artificial Sequence: Synthetic polynucleotide
atggctgaaactgctggctctccaacctccactgaggaaggtgcatccccgggcaccagctctaccggttctccaggtagctctaccccgtctggtgctaccggctctccaggtagctctaccccgtctggtgctactggctctccaggtagcccggctggctctcctacctctactgag

SEQ ID NO: 749 - protein, 6 aa, Artificial Sequence
  Description of Artificial Sequence: Synthetic peptide
ENLYFQ

SEQ ID NO: 750 - protein, 6 aa, Artificial Sequence
  Description of Artificial Sequence: Synthetic peptide
ENLYFQ

SEQ ID NO: 751 - protein, 8 aa, Artificial Sequence
  Description of Artificial Sequence: Synthetic peptide
LGPVSGVP

SEQ ID NO: 752 - protein, 8 aa, Artificial Sequence
  Description of Artificial Sequence: Synthetic peptide
GPAGLGGA

SEQ ID NO: 753 - protein, 12 aa, Artificial Sequence
  Description of Artificial Sequence: Synthetic peptide
GSTSESPSGTAP

SEQ ID NO: 754 - protein, 12 aa, Artificial Sequence
  Description of Artificial Sequence: Synthetic peptide
GTSTPESGSASP

SEQ ID NO: 755 - protein, 12 aa, Artificial Sequence
  Description of Artificial Sequence: Synthetic peptide
GTSPSGESSTAP

SEQ ID NO: 756 - protein, 12 aa, Artificial Sequence
  Description of Artificial Sequence: Synthetic peptide
GSTSSTAESPGP

SEQ ID NO: 757 - protein, 24 aa, Artificial Sequence
  Description of Artificial Sequence: Synthetic peptide
GSPAGSPTSTEEGTSESATPESGP

SEQ ID NO: 758 - protein, 36 aa, Artificial Sequence; identical to SEQ ID NO: 366
  Description of Artificial Sequence: Synthetic polypeptide

SEQ ID NO: 759 - protein, 48 aa, Artificial Sequence
  Description of Artificial Sequence: Synthetic polypeptide
GSPAGSPTSTEEGTSESATPESGPGTSTEPSEGSAPGSPAGSPTSTEE

SEQ ID NO: 760 - protein, 60 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAP

SEQ ID NO: 761 - protein, 108 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETP

SEQ ID NO: 762 - protein, 216 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAP

SEQ ID NO: 763 - protein, 432 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAP

SEQ ID NO: 764 - protein, 864 aa, Artificial Sequence; identical to SEQ ID NO: 199
  Description of Artificial Sequence: Synthetic polypeptide

SEQ ID NO: 765 - protein, 576 aa, Artificial Sequence; identical to SEQ ID NO: 194
  Description of Artificial Sequence: Synthetic polypeptide

SEQ ID NO: 766 - protein, 576 aa, Artificial Sequence; identical to SEQ ID NO: 195
  Description of Artificial Sequence: Synthetic polypeptide

SEQ ID NO: 767 - protein, 540 aa, Artificial Sequence; identical to SEQ ID NO: 193
  Description of Artificial Sequence: Synthetic polypeptide

SEQ ID NO: 768 - protein, 504 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 769 - protein, 864 aa, Artificial Sequence; identical to SEQ ID NO: 199
  Description of Artificial Sequence: Synthetic polypeptide

SEQ ID NO: 770 - protein, 875 aa, Artificial Sequence; identical to SEQ ID NO: 200
  Description of Artificial Sequence: Synthetic polypeptide
  MOD_RES (430)..(432): Any amino acid
  MOD_RES (443)..(446): Any amino acid

SEQ ID NO: 771 - protein, 868 aa, Artificial Sequence
  Description of Artificial Sequence: Synthetic polypeptide
GGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 772 - protein, 875 aa, Artificial Sequence; identical to SEQ ID NO: 202
  Description of Artificial Sequence: Synthetic polypeptide

SEQ ID NO: 773 - protein, 1318 aa, Artificial Sequence; identical to SEQ ID NO: 205
  Description of Artificial Sequence: Synthetic polypeptide

SEQ ID NO: 774 - protein, 924 aa, Artificial Sequence; identical to SEQ ID NO: 204
  Description of Artificial Sequence: Synthetic polypeptide

SEQ ID NO: 775 - protein, 913 aa, Artificial Sequence; identical to SEQ ID NO: 203
  Description of Artificial Sequence: Synthetic polypeptide

SEQ ID NO: 776 - protein, 864 aa, Artificial Sequence; identical to SEQ ID NO: 206
  Description of Artificial Sequence: Synthetic polypeptide

SEQ ID NO: 777 - protein, 84 aa, Artificial Sequence
  Description of Artificial Sequence: Synthetic polypeptide
ASPAAPAPASPAAPAPSAPAAAPASPAPAAPSAPAPAAPSAASPAAPSAPPAAASPAAPSAPPAASAAAPAAASAAASAPSAAA

SEQ ID NO: 778 - protein, 4 aa, Artificial Sequence
  Description of Artificial Sequence: Synthetic peptide
GGSG

SEQ ID NO: 779 - protein, 288 aa, Artificial Sequence
  Description of Artificial Sequence: Synthetic polypeptide
GSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEG

SEQ ID NO: 780 - protein, 288 aa, Artificial Sequence
  Description of Artificial Sequence: Synthetic polypeptide
GEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEG

SEQ ID NO: 781 - protein, 288 aa, Artificial Sequence
  Description of Artificial Sequence: Synthetic polypeptide
SSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSES

SEQ ID NO: 782 - protein, 288 aa, Artificial Sequence
  Description of Artificial Sequence: Synthetic polypeptide
GEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGE

SEQ ID NO: 783 - protein, 576 aa, Artificial Sequence
  Description of Artificial Sequence: Synthetic polypeptide
GGKPGEGGKPEGGGGKPGGKPEGEGEGKPGGKPEGGGKPGGGEGGKPEGGKPEGEGKPGGGEGKPGGKPEGGGGKPEGEGKPGGGGGKPGGKPEGEGKPGGGEGGKPEGKPGEGGEGKPGGKPEGGGEGKPGGGKPGEGGKPGEGKPGGGEGGKPEGGKPEGEGKPGGGEGKPGGKPGEGGKPEGGGEGKPGGKPGEGGEGKPGGGKPEGEGKPGGGKPGGGEGGKPEGEGKPGGKPEGGGEGKPGGKPEGGGKPEGGGEGKPGGGKPGEGGKPGEGEGKPGGKPEGEGKPGGEGGGKPEGKPGGGEGGKPEGGKPGEGGKPEGGKPGEGGEGKPGGGKPGEGGKPEGGGKPEGEGKPGGGGKPGEGGKPEGGKPEGGGEGKPGGGKPEGEGKPGGGEGKPGGKPEGGGGKPGEGGKPEGGKPGGEGGGKPEGEGKPGGKPGEGGGGKPGGKPEGEGKPGEGGEGKPGGKPEGGGEGKPGGKPEGGGEGKPGGGKPGEGGKPEGGGKPGEGGKPGEGGKPEGEGKPGGGEGKPGGKPGEGGKPEGGGEGKPGGKPGGEGGGKPEGGKPGEGGKPEG

SEQ ID NO: 784 - protein, 558 aa, Artificial Sequence
  Description of Artificial Sequence: Synthetic polypeptide
GEGKPGGKPGSGGGKPGEGGKPGSGEGKPGGKPGSGGSGKPGGKPGEGGKPEGGSGGKPGGGGKPGGKPGGEGSGKPGGKPEGGGKPEGGSGGKPGGKPEGGSGGKPGGKPGSGEGGKPGGGKPGGEGKPGSGKPGGEGSGKPGGKPEGGSGGKPGGKPEGGSGGKPGGSGKPGGKPGEGGKPEGGSGGKPGGSGKPGGKPEGGGSGKPGGKPGEGGKPGSGEGGKPGGGKPGGEGKPGSGKPGGEGSGKPGGKPGSGGEGKPGGKPEGGSGGKPGGGKPGGEGKPGSGGKPGEGGKPGSGGGKPGGKPGGEGEGKPGGKPGEGGKPGGEGSGKPGGGGKPGGKPGGEGGKPEGSGKPGGGSGKPGGKPEGGGGKPEGSGKPGGGGKPEGSGKPGGGKPEGGSGGKPGGSGKPGGKPGEGGGKPEGSGKPGGGSGKPGGKPEGGGKPEGGSGGKPGGKPEGGSGGKPGGKPGGEGSGKPGGKPGSGEGGKPGGKPGEGSGGKPGGKPEGGSGGKPGGSGKPGGKPEGGGSGKPGGKPGEGGKPGGEGSGKPGGSGKPG

SEQ ID NO: 785 - protein, 577 aa, Artificial Sequence
  Description of Artificial Sequence: Synthetic polypeptide
GGSGKPGKPGGSGSGKPGSGKPGGGSGKPGSGKPGGGSGKPGSGKPGGGSGKPGSGKPGGGGKPGSGSGKPGGGKPGGSGGKPGGGSGKPGKPGSGGSGKPGSGKPGGGSGGKPGKPGSGGSGGKPGKPGSGGGSGKPGKPGSGGSGGKPGKPGSGGSGGKPGKPGSGGSGKPGSGKPGGGSGKPGSGKPGSGGSGKPGKPGSGGSGKPGSGKPGSGSGKPGSGKPGGGSGKPGSGKPGSGGSGKPGKPGSGGGKPGSGSGKPGGGKPGSGSGKPGGGKPGGSGGKPGGSGGKPGKPGSGGGSGKPGKPGSGGGSGKPGKPGGSGSGKPGSGKPGGGSGKPGSGKPGSGGSGKPGKPGSGGSGGKPGKPGSGGGKPGSGSGKPGGGKPGSGSGKPGGGKPGSGSGKPGGGKPGSGSGKPGGSGKPGSGKPGGGSGGKPGKPGSGGSGKPGSGKPGSGGSGKPGKPGGSGSGKPGSGKPGGGSGKPGSGKPGGGSGKPGSGKPGGGSGKPGSGKPGGGGKPGSGSGKPGGSGGKPGKPGSGGSGGKPGKPGSGGSGKPGSGKPGGGSGGKPGKPGSGG

SEQ ID NO: 786 - protein, 576 aa, Artificial Sequence
  Description of Artificial Sequence: Synthetic polypeptide
GEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGEGSEGSGEGEGSEGSGEGEGSEGGSEGEGGSEGSEGEGSGEGSEGEGGSEGSEGEGGGEGSEGEGSGEGSEGEGGSEGSEGEGGSEGSEGEGGEGSGEGEGSEGSGEGEGSGEGSEGEGSEGSGEGEGSEGSGEGEGGSEGSEGEGSGEGSEGEGSEGSGEGEGSEGSGEGEGGSEGSEGEGGSEGSEGEGGSEGSEGEGGEGSGEGEGSEGSGEGEGSGEGSEGEGSEGSGEGEGSEGSGEGEGGSEGSEGEGSEGSGEGEGGEGSGEGEGSGEGSEGEGGGEGSEGEGSEGSGEGEGSEGSGEGEGSEGGSEGEGGSEGSEGEGSEGGSEGEGSEGGSEGEGSEGSGEGEGSEGSGEGEGSGEGSEGEGGSEGGEGEGSEGGSEGEGSEGGSEGEGGEGSGEGEGGGEGSEGEGSEGSGEGEGSGEGSE

SEQ ID NO: 787 - protein, 576 aa, Artificial Sequence; identical to SEQ ID NO: 194
  Description of Artificial Sequence: Synthetic polypeptide

SEQ ID NO: 788 - protein, 577 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 789 - protein, 540 aa, Artificial Sequence; identical to SEQ ID NO: 193
  Description of Artificial Sequence: Synthetic polypeptide

SEQ ID NO: 790 - protein, 504 aa, Artificial Sequence; identical to SEQ ID NO: 768
  Description of Artificial Sequence: Synthetic polypeptide

SEQ ID NO: 791 - protein, 816 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAP

SEQ ID NO: 792 - protein, 875 aa, Artificial Sequence; identical to SEQ ID NO: 200
  Description of Artificial Sequence: Synthetic polypeptide
  MOD_RES (430)..(432): Any amino acid
  MOD_RES (443)..(446): Any amino acid

SEQ ID NO: 793 - protein, 868 aa, Artificial Sequence; identical to SEQ ID NO: 771
  Description of Artificial Sequence: Synthetic polypeptide

SEQ ID NO: 794 - protein, 875 aa, Artificial Sequence; identical to SEQ ID NO: 202
  Description of Artificial Sequence: Synthetic polypeptide

SEQ ID NO: 795 - protein, 1318 aa, Artificial Sequence; identical to SEQ ID NO: 205
  Description of Artificial Sequence: Synthetic polypeptide

SEQ ID NO: 796 - protein, 9 aa, Artificial Sequence
  Description of Artificial Sequence: Synthetic peptide
FDKLPRTSG

SEQ ID NO: 797 - protein, 7 aa, Artificial Sequence
  Description of Artificial Sequence: Synthetic peptide
FKLMVWY

SEQ ID NO: 798 - protein, 318 aa, Artificial Sequence
  Description of Artificial Sequence: Synthetic polypeptide
HSQGTFTSDYSKYLDSRRAQDFVQWLMNTGGEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGE

SEQ ID NO: 799 - DNA, 954 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggtgagggttctggcgaaggttccgaaggtgagggctccgaaggatctggcgaaggtgagggttccgaaggttctggcgaaggtgaaggcggttctgagggatccgaaggtgaaggcggttctgagggatctgaaggtgaaggtggctctgaaggatctgaaggtgagggatctggtgaaggttctgaaggtgaaggcggctctgagggttctgaaggtgaaggatctggtgaaggttccgaaggtgagggttctgaaggtggttctgaaggtgaaggcggttctgagggttctgaaggtgagggttctggcgaaggttccgaaggtgaaggcggcgaaggtggatctgaaggtgagggctccgaaggatctggcgaaggtgaaggttctggcgaaggttccgaaggtgaaggttctgaaggatctggcgaaggtgagggttctggcgaaggttccgaaggtgagggctccgaaggatctggcgaaggtgagggttccgaaggttctggcgaaggtgaaggcggttctgagggatccgaaggtgaaggctccgaaggatctggcgaaggtgaaggtggtgaaggttctggcgaaggtgagggatctggcgaaggctctgaaggtgaaggtggtggtgaaggctctgaaggtgaaggatctggtgaaggtggcgaaggtgagggatctgaaggcggctccgaaggtgaaggcggatctgaaggcggcgaaggtgaaggttccgaaggttctggtgaaggtgaaggatctgaaggtggctccgaaggtgaaggatctgaaggcggttccgaaggtgagggctctgaaggttctggcgaaggtgaaggctctgaaggatctggtgaa

SEQ ID NO: 800 - protein, 174 aa, Artificial Sequence
  Description of Artificial Sequence: Synthetic polypeptide
HSQGTFTSDYSKYLDSRRAQDFVQWLMNTGGEGGSEGSEGEGSEGSGEGEGGSEGSEGEGSEGSGEGEGGSEGSEGEGGSEGSEGEGGEGSGEGEGSEGSGEGEGSGEGSEGEGGSEGGEGEGSEGGSEGEGSEGGSEGEGGEGSGEGEGGGEGSEGEGSEGSGEGEGSGEGSE

SEQ ID NO: 801 - DNA, 522 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggtgaaggtggctctgaaggatccgaaggtgagggctccgaaggatctggtgaaggtgaaggcggctctgagggatccgaaggtgaaggttctgaaggatctggtgaaggtgaaggcggttctgaaggttccgaaggtgaaggtggctctgagggatccgaaggtgaaggtggcgaaggatctggtgaaggtgaaggttctgaaggttctggcgaaggtgaaggatctggcgaaggctccgaaggtgaaggcggttctgaaggtggcgaaggtgaaggatctgaaggtggttccgaaggtgagggatctgaaggtggctctgaaggtgaaggtggcgaaggttctggcgaaggtgaaggtggaggcgaaggttctgaaggtgaaggttccgaaggttctggtgaaggtgagggatctggcgaaggttctgaa

SEQ ID NO: 802 - protein, 102 aa, Artificial Sequence
  Description of Artificial Sequence: Synthetic polypeptide
HSQGTFTSDYSKYLDSRRAQDFVQWLMNTGGEGSGEGSEGEGSEGSGEGEGSEGSGEGEGGSEGSEGEGGSEGSEGEGSEGGSEGEGGSEGSEGEGSEGGGE

SEQ ID NO: 803 - DNA, 306 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggtgagggttctggcgaaggttccgaaggtgagggctccgaaggatctggcgaaggtgagggttccgaaggttctggcgaaggtgaaggcggttctgagggatccgaaggtgaaggcggctctgaaggatccgaaggtgaaggatctgaaggtggttctgaaggtgaaggtggctctgagggatctgaaggtgaaggctctgaaggtggtggcgaa

SEQ ID NO: 804 - protein, 66 aa, Artificial Sequence
  Description of Artificial Sequence: Synthetic polypeptide
HSQGTFTSDYSKYLDSRRAQDFVQWLMNTGGEGSGEGSEGEGSEGSGEGEGSEGGSEGEGGSEGSE

SEQ ID NO: 805 - DNA, 198 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggtgaaggttctggtgaaggttctgaaggtgagggttctgaaggttctggcgaaggtgagggatctgaaggcggttctgaaggtgaaggtggctctgagggttccgaa

SEQ ID NO: 806 - protein, 174 aa, Artificial Sequence
  Description of Artificial Sequence: Synthetic polypeptide
HSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 807 - DNA, 522 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 808 - protein, 318 aa, Artificial Sequence
  Description of Artificial Sequence: Synthetic polypeptide
HSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 809 - DNA, 954 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 810 - protein, 174 aa, Artificial Sequence
  Description of Artificial Sequence: Synthetic polypeptide
HSQGTFTSDYSKYLDSRRAQDFVQWLMNTGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 811 - DNA, 522 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcacca

SEQ ID NO: 812 - protein, 606 aa, Artificial Sequence
  Description of Artificial Sequence: Synthetic polypeptide
HSQGTFTSDYSKYLDSRRAQDFVQWLMNTGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 813 - DNA, 1818 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctca

SEQ ID NO: 814 - protein, 606 aa, Artificial Sequence
  Description of Artificial Sequence: Synthetic polypeptide
HSQGTFTSDYSKYLDSRRAQDFVQWLMNTGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 815 - DNA, 1818 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 816 - protein, 606 aa, Artificial Sequence
  Description of Artificial Sequence: Synthetic polypeptide
HSQGTFTSDYSKYLDSRRAQDFVQWLMNTGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 817 - DNA, 1818 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctcca

SEQ ID NO: 818 - protein, 866 aa, Artificial Sequence
  Description of Artificial Sequence: Synthetic polypeptide
HSQGTFTSDYSKYLDSRRAQDFVQWLMNTGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 819 - DNA, 2598 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctca

SEQ ID NO: 820 - protein, 894 aa, Artificial Sequence
  Description of Artificial Sequence: Synthetic polypeptide
HSQGTFTSDYSKYLDSRRAQDFVQWLMNTGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 821 - DNA, 2682 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 822 - protein, 905 aa, Artificial Sequence
  Description of Artificial Sequence: Synthetic polypeptide
  MOD_RES (460)..(462): Any amino acid
  MOD_RES (473)..(476): Any amino acid
HSQGTFTSDYSKYLDSRRAQDFVQWLMNTGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 823 - DNA, 2715 bp, Artificial Sequence
  Description of Artificial Sequence: Synthetic polynucleotide
  modified_base (1377)..(1388): a, c, t, g, unknown or other
  modified_base (1420)..(1427): a, c, t, g, unknown or other
cactctcagggtacgttcacctccgactactccaaatacctggattctcgtcgcgctcaagatttcgttcagtggctgatgaacactggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 824 - protein, 894 aa, Artificial Sequence
  Description of Artificial Sequence: Synthetic polypeptide
HSQGTFTSDYSKYLDSRRAQDFVQWLMNTGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 825 - DNA, 2682 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 826 - protein, 905 aa, Artificial Sequence
  Description of Artificial Sequence: Synthetic polypeptide
HSQGTFTSDYSKYLDSRRAQDFVQWLMNTGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 827 - DNA, 2715 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 828 - protein, 1348 aa, Artificial Sequence
  Description of Artificial Sequence: Synthetic polypeptide
HSQGTFTSDYSKYLDSRRAQDFVQWLMNTGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 829 - DNA, 4044 bp, Artificial Sequence
  Description of Artificial Sequence: Synthetic polynucleotide
cactctcagggtacgttcacctccgactactccaaatacctggattctcgtcgcgctcaagatttcgttcagtggctgatgaacactggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 830 - protein, 79 aa, Artificial Sequence
  Description of Artificial Sequence: Synthetic polypeptide
MAEPAGSPTSTEEGTPGSGTASSSPGSSTPSGATGSPGASPGTSSTGSPGHSQGTFTSDYSKYLDSRRAQDFVQWLMNT

SEQ ID NO: 831 - DNA, 237 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtcactctcagggtacgttcacctccgactactccaaatacctggattctcgtcgcgctcaagatttcgttcagtggctgatgaacact

SEQ ID NO: 832 - protein, 79 aa, Artificial Sequence
  Description of Artificial Sequence: Synthetic polypeptide
MAEPAGSPTSTEEGASPGTSSTGSPGSSTPSGATGSPGSSTPSGATGSPGHSQGTFTSDYSKYLDSRRAQDFVQWLMNT

SEQ ID NO: 833 - DNA, 237 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtcactctcagggtacgttcacctccgactactccaaatacctggattctcgtcgcgctcaagatttcgttcagtggctgatgaacact

SEQ ID NO: 834 - protein, 606 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGHSQGTFTSDYSKYLDSRRAQDFVQWLMNT

SEQ ID NO: 835 - DNA, 1818 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctcaggtcactctcagggtacgttcacctccgactactccaaatacctggattctcgtcgcgctcaagatttcgttcagtggctgatgaacact

SEQ ID NO: 836 - protein, 606 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHSQGTFTSDYSKYLDSRRAQDFVQWLMNT

SEQ ID NO: 837 - DNA, 1818 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcactctcagggtacgttcacctccgactactccaaatacctggattctcgtcgcgctcaagatttcgttcagtggctgatgaacact

SEQ ID NO: 838 - protein, 606 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGHSQGTFTSDYSKYLDSRRAQDFVQWLMNT

SEQ ID NO: 839 - DNA, 1818 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctccaggtcactctcagggtacgttcacctccgactactccaaatacctggattctcgtcgcgctcaagatttcgttcagtggctgatgaacact

SEQ ID NO: 840 - protein, 655 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHSQGTFTSDYSKYLDSRRAQDFVQWLMNT

SEQ ID NO: 841 - DNA, 1965 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcactctcagggtacgttcacctccgactactccaaatacctggattctcgtcgcgctcaagatttcgttcagtggctgatgaacact

SEQ ID NO: 842 - protein, 866 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGHSQGTFTSDYSKYLDSRRAQDFVQWLMNT

SEQ ID NO: 843 - DNA, 2598 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctcaggtcactctcagggtacgttcacctccgactactccaaatacctggattctcgtcgcgctcaagatttcgttcagtggctgatgaacact

SEQ ID NO: 844 - protein, 894 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHSQGTFTSDYSKYLDSRRAQDFVQWLMNT

SEQ ID NO: 845 - DNA, 2682 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcactctcagggtacgttcacctccgactactccaaatacctggattctcgtcgcgctcaagatttcgttcagtggctgatgaacact

SEQ ID NO: 846 - protein, 905 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGHSQGTFTSDYSKYLDSRRAQDFVQWLMNT

SEQ ID NO: 847 - DNA, 2715 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctccccaggtcactctcagggtacgttcacctccgactactccaaatacctggattctcgtcgcgctcaagatttcgttcagtggctgatgaacact

SEQ ID NO: 848 - protein, 894 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGHSQGTFTSDYSKYLDSRRAQDFVQWLMNT

SEQ ID NO: 849 - DNA, 2682 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctccaggtcactctcagggtacgttcacctccgactactccaaatacctggattctcgtcgcgctcaagatttcgttcagtggctgatgaacact

SEQ ID NO: 850 - protein, 905 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHSQGTFTSDYSKYLDSRRAQDFVQWLMNT

SEQ ID NO: 851 - DNA, 2715 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcactctcagggtacgttcacctccgactactccaaatacctggattctcgtcgcgctcaagatttcgttcagtggctgatgaacact

SEQ ID NO: 852 - protein, 943 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHSQGTFTSDYSKYLDSRRAQDFVQWLMNT

SEQ ID NO: 853 - DNA, 2829 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcactctcagggtacgttcacctccgactactccaaatacctggattctcgtcgcgctcaagatttcgttcagtggctgatgaacact

SEQ ID NO: 854 - protein, 954 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHSQGTFTSDYSKYLDSRRAQDFVQWLMNT

SEQ ID NO: 855 - DNA, 2862 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcactctcagggtacgttcacctccgactactccaaatacctggattctcgtcgcgctcaagatttcgttcagtggctgatgaacact

SEQ ID NO: 856 - protein, 89 aa, Artificial Sequence
  Description of Artificial Sequence: Synthetic polypeptide
MAEPAGSPTSTEEGTPGSGTASSSPGSSTPSGATGSPGASPGTSSTGSPGHGEGTFTSDLSKQMEEEAVRLFIEWLKNGGPSSGAPPPS

SEQ ID NO: 857 - DNA, 267 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 858 - protein, 89 aa, Artificial Sequence
  Description of Artificial Sequence: Synthetic polypeptide
MAEPAGSPTSTEEGASPGTSSTGSPGSSTPSGATGSPGSSTPSGATGSPGHGEGTFTSDLSKQMEEEAVRLFIEWLKNGGPSSGAPPPS

SEQ ID NO: 859 - DNA, 267 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 860 - protein, 616 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGHGEGTFTSDLSKQMEEEAVRLFIEWLKNGGPSSGAPPPS

SEQ ID NO: 861 - DNA, 1848 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctcaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 862 - protein, 616 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPS

SEQ ID NO: 863 - DNA, 1848 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 864 - protein, 616 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGHGEGTFTSDLSKQMEEEAVRLFIEWLKNGGPSSGAPPPS

SEQ ID NO: 865 - DNA, 1848 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctccaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 866 - protein, 665 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPS

SEQ ID NO: 867 - DNA, 1995 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 868 - protein, 876 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGHGEGTFTSDLSKQMEEEAVRLFIEWLKNGGPSSGAPPPS

SEQ ID NO: 869 - DNA, 2628 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctcaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 870 - protein, 904 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPS

SEQ ID NO: 871 - DNA, 2712 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 872 - protein, 915 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGHGEGTFTSDLSKQMEEEAVRLFIEWLKNGGPSSGAPPPS

SEQ ID NO: 873 - DNA, 2745 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctccccaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 874 - protein, 904 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGHGEGTFTSDLSKQMEEEAVRLFIEWLKNGGPSSGAPPPS

SEQ ID NO: 875 - DNA, 2712 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctccaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 876 - protein, 915 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPS

SEQ ID NO: 877 - DNA, 2745 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 878 - protein, 953 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPS

SEQ ID NO: 879 - DNA, 2859 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 880 - protein, 964 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPS

SEQ ID NO: 881 - DNA, 2892 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtct

SEQ ID NO: 882 - protein, 184 aa, Artificial Sequence
  Description of Artificial Sequence: Synthetic polypeptide
HGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 883 - DNA, 552 bp, Artificial Sequence
  Description of Artificial Sequence: Synthetic polynucleotide
cacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 884 - protein, 328 aa, Artificial Sequence
  Description of Artificial Sequence: Synthetic polypeptide
HGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 885 - DNA, 984 bp, Artificial Sequence
  Description of Artificial Sequence: Synthetic polynucleotide
cacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 886 - protein, 184 aa, Artificial Sequence
  Description of Artificial Sequence: Synthetic polypeptide
HGEGTFTSDLSKQMEEEAVRLFIEWLKNGGPSSGAPPPSGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 887 - DNA, 552 bp, Artificial Sequence
  Description of Artificial Sequence: Synthetic polynucleotide
cacggtgagggcactttcacgtccgacctgtccaagcagatggaggaagaagcggttcgcctcttcatcgagtggctgaaaaacggtggtccgtcctctggtgcgcctccgccgtctggtggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcacca

SEQ ID NO: 888 - protein, 616 aa, Artificial Sequence
  Description of Artificial Sequence: Synthetic polypeptide
HGEGTFTSDLSKQMEEEAVRLFIEWLKNGGPSSGAPPPSGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 889 - DNA, 1848 bp, Artificial Sequence
  Description of Artificial Sequence: Synthetic polynucleotide
cacggtgagggcactttcacgtccgacctgtccaagcagatggaggaagaagcggttcgcctcttcatcgagtggctgaaaaacggtggtccgtcctctggtgcgcctccgccgtctggtggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctca

SEQ ID NO: 890 - protein, 616 aa, Artificial Sequence
  Description of Artificial Sequence: Synthetic polypeptide
HGEGTFTSDLSKQMEEEAVRLFIEWLKNGGPSSGAPPPSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 891 - DNA, 1848 bp, Artificial Sequence
  Description of Artificial Sequence: Synthetic polynucleotide
cacggtgagggcactttcacgtccgacctgtccaagcagatggaggaagaagcggttcgcctcttcatcgagtggctgaaaaacggtggtccgtcctctggtgcgcctccgccgtctggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 892 - protein, 617 aa, Artificial Sequence
  Description of Artificial Sequence: Synthetic polypeptide
HGEGTFTSDLSKQMEEEAVRLFIEWLKNGGPSSGAPPPSGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPG

SEQ ID NO: 893 - DNA, 1854 bp, Artificial Sequence
  Description of Artificial Sequence: Synthetic polynucleotide
cacggtgagggcactttcacgtccgacctgtccaagcagatggaggaagaagcggttcgcctcttcatcgagtggctgaaaaacggtggtccgtcctctggtgcgcctccgccgtctggtggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctccaggttaa

SEQ ID NO: 894 - protein, 876 aa, Artificial Sequence
  Description of Artificial Sequence: Synthetic polypeptide
HGEGTFTSDLSKQMEEEAVRLFIEWLKNGGPSSGAPPPSGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 895 - DNA, 2628 bp, Artificial Sequence
  Description of Artificial Sequence: Synthetic polynucleotide
cacggtgagggcactttcacgtccgacctgtccaagcagatggaggaagaagcggttcgcctcttcatcgagtggctgaaaaacggtggtccgtcctctggtgcgcctccgccgtctggtggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctca

SEQ ID NO: 896 - protein, 904 aa, Artificial Sequence
  Description of Artificial Sequence: Synthetic polypeptide
HGEGTFTSDLSKQMEEEAVRLFIEWLKNGGPSSGAPPPSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 897 - DNA, 2712 bp, Artificial Sequence
  Description of Artificial Sequence: Synthetic polynucleotide
cacggtgagggcactttcacgtccgacctgtccaagcagatggaggaagaagcggttcgcctcttcatcgagtggctgaaaaacggtggtccgtcctctggtgcgcctccgccgtctggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 898 - protein, 915 aa, Artificial Sequence
  Description of Artificial Sequence: Synthetic polypeptide
  MOD_RES (470)..(472): Any amino acid
  MOD_RES (483)..(486): Any amino acid
HGEGTFTSDLSKQMEEEAVRLFIEWLKNGGPSSGAPPPSGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 899 - DNA, 2745 bp, Artificial Sequence
  Description of Artificial Sequence: Synthetic polynucleotide
  modified_base (1407)..(1418): a, c, t, g, unknown or other
  modified_base (1450)..(1457): a, c, t, g, unknown or other
cacggtgagggcactttcacgtccgacctgtccaagcagatggaggaagaagcggttcgcctcttcatcgagtggctgaaaaacggtggtccgtcctctggtgcgcctccgccgtctggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 900 - protein, 904 aa, Artificial Sequence
  Description of Artificial Sequence: Synthetic polypeptide
HGEGTFTSDLSKQMEEEAVRLFIEWLKNGGPSSGAPPPSGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 901 - DNA, 2712 bp, Artificial Sequence
  Description of Artificial Sequence: Synthetic polynucleotide
cacggtgagggcactttcacgtccgacctgtccaagcagatggaggaagaagcggttcgcctcttcatcgagtggctgaaaaacggtggtccgtcctctggtgcgcctccgccgtctggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 902 - protein, 915 aa, Artificial Sequence
  Description of Artificial Sequence: Synthetic polypeptide
HGEGTFTSDLSKQMEEEAVRLFIEWLKNGGPSSGAPPPSGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 903 - DNA, 2745 bp, Artificial Sequence
  Description of Artificial Sequence: Synthetic polynucleotide
cacggtgagggcactttcacgtccgacctgtccaagcagatggaggaagaagcggttcgcctcttcatcgagtggctgaaaaacggtggtccgtcctctggtgcgcctccgccgtctggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 904 - protein, 1358 aa, Artificial Sequence
  Description of Artificial Sequence: Synthetic polypeptide
HGEGTFTSDLSKQMEEEAVRLFIEWLKNGGPSSGAPPPSGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 905 - DNA, 4074 bp, Artificial Sequence
  Description of Artificial Sequence: Synthetic polynucleotide
cacggtgagggcactttcacgtccgacctgtccaagcagatggaggaagaagcggttcgcctcttcatcgagtggctgaaaaacggtggtccgtcctctggtgcgcctccgccgtctggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 906 - protein, 182 aa, Artificial Sequence
  Description of Artificial Sequence: Synthetic polypeptide
KCNTATCATQRLANFLVHSSNNFGAILSSTNVGSNTYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 907 - DNA, 546 bp, Artificial Sequence
  Description of Artificial Sequence: Synthetic polynucleotide
aaatgcaacaccgcgacctgcgcgacccagcgcctggcgaactttctggtgcatagcagcaacaactttggcgcgattctgtcctctaccaacgtgggcagcaacacctatggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 908 - protein, 326 aa, Artificial Sequence
  Description of Artificial Sequence: Synthetic polypeptide
KCNTATCATQRLANFLVHSSNNFGAILSSTNVGSNTYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 909 - DNA, 978 bp, Artificial Sequence
  Description of Artificial Sequence: Synthetic polynucleotide
aaatgcaacaccgcgacctgcgcgacccagcgcctggcgaactttctggtgcatagcagcaacaactttggcgcgattctgtcctctaccaacgtgggcagcaacacctatggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 910 - protein, 182 aa, Artificial Sequence
  Description of Artificial Sequence: Synthetic polypeptide
KCNTATCATQRLANFLVHSSNNFGAILSSTNVGSNTYGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 911 - DNA, 546 bp, Artificial Sequence
  Description of Artificial Sequence: Synthetic polynucleotide
aaatgcaacaccgcgacctgcgcgacccagcgcctggcgaactttctggtgcatagcagcaacaactttggcgcgattctgtcctctaccaacgtgggcagcaacacctatggtggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcacca

SEQ ID NO: 912 - protein, 614 aa, Artificial Sequence
  Description of Artificial Sequence: Synthetic polypeptide
KCNTATCATQRLANFLVHSSNNFGAILSSTNVGSNTYGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 913 - DNA, 1842 bp, Artificial Sequence
  Description of Artificial Sequence: Synthetic polynucleotide
aaatgcaacaccgcgacctgcgcgacccagcgcctggcgaactttctggtgcatagcagcaacaactttggcgcgattctgtcctctaccaacgtgggcagcaacacctatggtggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctca

SEQ ID NO: 914 - protein, 614 aa, Artificial Sequence
  Description of Artificial Sequence: Synthetic polypeptide
KCNTATCATQRLANFLVHSSNNFGAILSSTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 915 - DNA, 1842 bp, Artificial Sequence
  Description of Artificial Sequence: Synthetic polynucleotide
aaatgcaacaccgcgacctgcgcgacccagcgcctggcgaactttctggtgcatagcagcaacaactttggcgcgattctgtcctctaccaacgtgggcagcaacacctatggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 916 - protein, 614 aa, Artificial Sequence
  Description of Artificial Sequence: Synthetic polypeptide
KCNTATCATQRLANFLVHSSNNFGAILSSTNVGSNTYGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 917 - DNA, 1842 bp, Artificial Sequence
  Description of Artificial Sequence: Synthetic polynucleotide
aaatgcaacaccgcgacctgcgcgacccagcgcctggcgaactttctggtgcatagcagcaacaactttggcgcgattctgtcctctaccaacgtgggcagcaacacctatggtggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctcca

SEQ ID NO: 918 - protein, 874 aa, Artificial Sequence
  Description of Artificial Sequence: Synthetic polypeptide
KCNTATCATQRLANFLVHSSNNFGAILSSTNVGSNTYGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 919 - DNA, 2622 bp, Artificial Sequence
  Description of Artificial Sequence: Synthetic polynucleotide
aaatgcaacaccgcgacctgcgcgacccagcgcctggcgaactttctggtgcatagcagcaacaactttggcgcgattctgtcctctaccaacgtgggcagcaacacctatggtggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctca

SEQ ID NO: 920 - protein, 902 aa, Artificial Sequence
  Description of Artificial Sequence: Synthetic polypeptide
KCNTATCATQRLANFLVHSSNNFGAILSSTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 921 - DNA, 2706 bp, Artificial Sequence
  Description of Artificial Sequence: Synthetic polynucleotide
aaatgcaacaccgcgacctgcgcgacccagcgcctggcgaactttctggtgcatagcagcaacaactttggcgcgattctgtcctctaccaacgtgggcagcaacacctatggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 922 - protein, 913 aa, Artificial Sequence
  Description of Artificial Sequence: Synthetic polypeptide
  MOD_RES (468)..(470): Any amino acid
  MOD_RES (481)..(484): Any amino acid
KCNTATCATQRLANFLVHSSNNFGAILSSTNVGSNTYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 923 - DNA, 2739 bp, Artificial Sequence
  Description of Artificial Sequence: Synthetic polynucleotide
  modified_base (1401)..(1412): a, c, t, g, unknown or other
  modified_base (1444)..(1451): a, c, t, g, unknown or other
aaatgcaacaccgcgacctgcgcgacccagcgcctggcgaactttctggtgcatagcagcaacaactttggcgcgattctgtcctctaccaacgtgggcagcaacacctatggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 924 - protein, 902 aa, Artificial Sequence
  Description of Artificial Sequence: Synthetic polypeptide
KCNTATCATQRLANFLVHSSNNFGAILSSTNVGSNTYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 925 - DNA, 2706 bp, Artificial Sequence
  Description of Artificial Sequence: Synthetic polynucleotide
aaatgcaacaccgcgacctgcgcgacccagcgcctggcgaactttctggtgcatagcagcaacaactttggcgcgattctgtcctctaccaacgtgggcagcaacacctatggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 926 - protein, 1356 aa, Artificial Sequence
  Description of Artificial Sequence: Synthetic polypeptide
KCNTATCATQRLANFLVHSSNNFGAILSSTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 927 - DNA, 4068 bp, Artificial Sequence
  Description of Artificial Sequence: Synthetic polynucleotide
aaatgcaacaccgcgacctgcgcgacccagcgcctggcgaactttctggtgcatagcagcaacaactttggcgcgattctgtcctctaccaacgtgggcagcaacacctatggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 928 - protein, 87 aa, Artificial Sequence
  Description of Artificial Sequence: Synthetic polypeptide
MAEPAGSPTSTEEGTPGSGTASSSPGSSTPSGATGSPGASPGTSSTGSPGKCNTATCATQRLANFLVHSSNNFGAILSSTNVGSNTY

SEQ ID NO: 929 - DNA, 261 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtaaatgcaacaccgcgacctgcgcgacccagcgcctggcgaactttctggtgcatagcagcaacaactttggcgcgattctgtcctctaccaacgtgggcagcaacacctat

SEQ ID NO: 930 - protein, 87 aa, Artificial Sequence
  Description of Artificial Sequence: Synthetic polypeptide
MAEPAGSPTSTEEGASPGTSSTGSPGSSTPSGATGSPGSSTPSGATGSPGKCNTATCATQRLANFLVHSSNNFGAILSSTNVGSNTY

SEQ ID NO: 931 - DNA, 261 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtaaatgcaacaccgcgacctgcgcgacccagcgcctggcgaactttctggtgcatagcagcaacaactttggcgcgattctgtcctctaccaacgtgggcagcaacacctat

SEQ ID NO: 932 - protein, 614 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGKCNTATCATQRLANFLVHSSNNFGAILSSTNVGSNTY

SEQ ID NO: 933 - DNA, 1842 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctcaggtaaatgcaacaccgcgacctgcgcgacccagcgcctggcgaactttctggtgcatagcagcaacaactttggcgcgattctgtcctctaccaacgtgggcagcaacacctat

SEQ ID NO: 934 - protein, 614 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGAILSSTNVGSNTY

SEQ ID NO: 935 - DNA, 1842 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtaaatgcaacaccgcgacctgcgcgacccagcgcctggcgaactttctggtgcatagcagcaacaactttggcgcgattctgtcctctaccaacgtgggcagcaacacctat

SEQ ID NO: 936 - protein, 614 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGKCNTATCATQRLANFLVHSSNNFGAILSSTNVGSNTY

SEQ ID NO: 937 - DNA, 1842 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctccaggtaaatgcaacaccgcgacctgcgcgacccagcgcctggcgaactttctggtgcatagcagcaacaactttggcgcgattctgtcctctaccaacgtgggcagcaacacctat

SEQ ID NO: 938 - protein, 663 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGAILSSTNVGSNTY

SEQ ID NO: 939 - DNA, 1989 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtaaatgcaacaccgcgacctgcgcgacccagcgcctggcgaactttctggtgcatagcagcaacaactttggcgcgattctgtcctctaccaacgtgggcagcaacacctat

SEQ ID NO: 940 - protein, 874 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGKCNTATCATQRLANFLVHSSNNFGAILSSTNVGSNTY

SEQ ID NO: 941 - DNA, 2622 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctcaggtaaatgcaacaccgcgacctgcgcgacccagcgcctggcgaactttctggtgcatagcagcaacaactttggcgcgattctgtcctctaccaacgtgggcagcaacacctat

SEQ ID NO: 942 - protein, 902 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTY

SEQ ID NO: 943 - DNA, 2706 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgacccagcgcctggcgaactttctggtgcatagcagcaacaactttggcgcgattctgtcctctaccaacgtgggcagcaacacctat

SEQ ID NO: 944 - protein, 913 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGKCNTATCATQRLANFLVHSSNNFGAILSSTNVGSNTY

SEQ ID NO: 945 - DNA, 2739 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctccccaggtaaatgcaacaccgcgacctgcgcgacccagcgcctggcgaactttctggtgcatagcagcaacaactttggcgcgattctgtcctctaccaacgtgggcagcaacacctat

SEQ ID NO: 946 - protein, 902 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGKCNTATCATQRLANFLVHSSNNFGAILSSTNVGSNTY

SEQ ID NO: 947 - DNA, 2706 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctccaggtaaatgcaacaccgcgacctgcgcgacccagcgcctggcgaactttctggtgcatagcagcaacaactttggcgcgattctgtcctctaccaacgtgggcagcaacacctat

SEQ ID NO: 948 - protein, 913 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTY

SEQ ID NO: 949 - DNA, 2739 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgacccagcgcctggcgaactttctggtgcatagcagcaacaactttggcgcgattctgtcctctaccaacgtgggcagcaacacctat

SEQ ID NO: 950 - protein, 951 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTY

SEQ ID NO: 951 - DNA, 2853 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgacccagcgcctggcgaactttctggtgcatagcagcaacaactttggcgcgattctgtcctctaccaacgtgggcagcaacacctat

SEQ ID NO: 952 - protein, 962 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTY

SEQ ID NO: 953 - DNA, 2886 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgacccagcgcctggcgaactttctggtgcatagcagcaacaactttggcgcgattctgtcctctaccaacgtgggcagcaacacctat

SEQ ID NO: 954 - protein, 182 aa, Artificial Sequence
  Description of Artificial Sequence: Synthetic polypeptide
KCNTATCATQRLANFLVHSSNNFGPILPPTNVGSNTYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 955 - protein, 326 aa, Artificial Sequence
  Description of Artificial Sequence: Synthetic polypeptide
KCNTATCATQRLANFLVHSSNNFGPILPPTNVGSNTYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 956 - protein, 182 aa, Artificial Sequence
  Description of Artificial Sequence: Synthetic polypeptide
KCNTATCATQRLANFLVHSSNNFGPILPPTNVGSNTYGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 957 - protein, 614 aa, Artificial Sequence
  Description of Artificial Sequence: Synthetic polypeptide
KCNTATCATQRLANFLVHSSNNFGPILPPTNVGSNTYGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 958 - protein, 614 aa, Artificial Sequence
  Description of Artificial Sequence: Synthetic polypeptide
KCNTATCATQRLANFLVHSSNNFGPILPPTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 959 - protein, 614 aa, Artificial Sequence
  Description of Artificial Sequence: Synthetic polypeptide
KCNTATCATQRLANFLVHSSNNFGPILPPTNVGSNTYGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 960 - protein, 874 aa, Artificial Sequence
  Description of Artificial Sequence: Synthetic polypeptide
KCNTATCATQRLANFLVHSSNNFGPILPPTNVGSNTYGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 961 - protein, 902 aa, Artificial Sequence
  Description of Artificial Sequence: Synthetic polypeptide
KCNTATCATQRLANFLVHSSNNFGPILPPTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 962 - protein, 913 aa, Artificial Sequence
  Description of Artificial Sequence: Synthetic polypeptide
  MOD_RES (468)..(470): Any amino acid
  MOD_RES (481)..(484): Any amino acid
KCNTATCATQRLANFLVHSSNNFGPILPPTNVGSNTYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 963 - protein, 902 aa, Artificial Sequence
  Description of Artificial Sequence: Synthetic polypeptide
KCNTATCATQRLANFLVHSSNNFGPILPPTNVGSNTYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 964 - protein, 913 aa, Artificial Sequence
  Description of Artificial Sequence: Synthetic polypeptide
KCNTATCATQRLANFLVHSSNNFGPILPPTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 965 - protein, 1356 aa, Artificial Sequence
  Description of Artificial Sequence: Synthetic polypeptide
KCNTATCATQRLANFLVHSSNNFGPILPPTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 966 - protein, 87 aa, Artificial Sequence
  Description of Artificial Sequence: Synthetic polypeptide
MAEPAGSPTSTEEGTPGSGTASSSPGSSTPSGATGSPGASPGTSSTGSPGKCNTATCATQRLANFLVHSSNNFGPILPPTNVGSNTY

SEQ ID NO: 967 - protein, 87 aa, Artificial Sequence
  Description of Artificial Sequence: Synthetic polypeptide
MAEPAGSPTSTEEGASPGTSSTGSPGSSTPSGATGSPGSSTPSGATGSPGKCNTATCATQRLANFLVHSSNNFGPILPPTNVGSNTY

SEQ ID NO: 968 - protein, 614 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGKCNTATCATQRLANFLVHSSNNFGPILPPTNVGSNTY

SEQ ID NO: 969 - protein, 614 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGPILPPTNVGSNTY

SEQ ID NO: 970 - protein, 614 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGKCNTATCATQRLANFLVHSSNNFGPILPPTNVGSNTY

SEQ ID NO: 971 - protein, 663 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGPILPPTNVGSNTY

SEQ ID NO: 972 - protein, 874 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGKCNTATCATQRLANFLVHSSNNFGPILPPTNVGSNTY

SEQ ID NO: 973 - protein, 902 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGPILPPTNVGSNTY

SEQ ID NO: 974 - protein, 913 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGKCNTATCATQRLANFLVHSSNNFGPILPPTNVGSNTY

SEQ ID NO: 975 - protein, 902 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGKCNTATCATQRLANFLVHSSNNFGPILPPTNVGSNTY

SEQ ID NO: 976 - protein, 913 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGPILPPTNVGSNTY

SEQ ID NO: 977 - protein, 951 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGPILPPTNVGSNTY

SEQ ID NO: 978 - protein, 962 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGPILPPTNVGSNTY

SEQ ID NO: 979 - protein, 182 aa, Artificial Sequence
  Description of Artificial Sequence: Synthetic polypeptide
HDEFERHAEGTFTSDVSSTLEGQAALEFIAWLVKGRGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 980 - protein, 326 aa, Artificial Sequence
  Description of Artificial Sequence: Synthetic polypeptide
HDEFERHAEGTFTSDVSSTLEGQAALEFIAWLVKGRGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 981 - protein, 182 aa, Artificial Sequence
  Description of Artificial Sequence: Synthetic polypeptide
HDEFERHAEGTFTSDVSSTLEGQAALEFIAWLVKGRGGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 982 - protein, 614 aa, Artificial Sequence
  Description of Artificial Sequence: Synthetic polypeptide
HDEFERHAEGTFTSDVSSTLEGQAALEFIAWLVKGRGGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 983 - protein, 614 aa, Artificial Sequence
  Description of Artificial Sequence: Synthetic polypeptide
HDEFERHAEGTFTSDVSSTLEGQAALEFIAWLVKGRGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 984 - protein, 614 aa, Artificial Sequence
  Description of Artificial Sequence: Synthetic polypeptide
HDEFERHAEGTFTSDVSSTLEGQAALEFIAWLVKGRGGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 985 - protein, 874 aa, Artificial Sequence
  Description of Artificial Sequence: Synthetic polypeptide
HDEFERHAEGTFTSDVSSTLEGQAALEFIAWLVKGRGGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 986 - protein, 902 aa, Artificial Sequence
  Description of Artificial Sequence: Synthetic polypeptide
HDEFERHAEGTFTSDVSSTLEGQAALEFIAWLVKGRGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 987 - protein, 913 aa, Artificial Sequence
  Description of Artificial Sequence: Synthetic polypeptide
  MOD_RES (468)..(470): Any amino acid
  MOD_RES (481)..(484): Any amino acid
HDEFERHAEGTFTSDVSSTLEGQAALEFIAWLVKGRGGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 988 - protein, 902 aa, Artificial Sequence
  Description of Artificial Sequence: Synthetic polypeptide
HDEFERHAEGTFTSDVSSTLEGQAALEFIAWLVKGRGGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 989 - protein, 913 aa, Artificial Sequence
  Description of Artificial Sequence: Synthetic polypeptide
HDEFERHAEGTFTSDVSSTLEGQAALEFIAWLVKGRGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 990 - protein, 1356 aa, Artificial Sequence
  Description of Artificial Sequence: Synthetic polypeptide
HDEFERHAEGTFTSDVSSTLEGQAALEFIAWLVKGRGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 991 - protein, 87 aa, Artificial Sequence
  Description of Artificial Sequence: Synthetic polypeptide
MAEPAGSPTSTEEGTPGSGTASSSPGSSTPSGATGSPGASPGTSSTGSPGHDEFERHAEGTFTSDVSSTLEGQAALEFIAWLVKGRG

SEQ ID NO: 992 - protein, 87 aa, Artificial Sequence
  Description of Artificial Sequence: Synthetic polypeptide
MAEPAGSPTSTEEGASPGTSSTGSPGSSTPSGATGSPGSSTPSGATGSPGHDEFERHAEGTFTSDVSSTLEGQAALEFIAWLVKGRG

SEQ ID NO: 993 - protein, 614 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGHDEFERHAEGTFTSDVSSTLEGQAALEFIAWLVKGRG

SEQ ID NO: 994 - protein, 614 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHDEFERHAEGTFTSDVSSTLEGQAALEFIAWLVKGRG

SEQ ID NO: 995 - protein, 614 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGHDEFERHAEGTFTSDVSSTLEGQAALEFIAWLVKGRG

SEQ ID NO: 996 - protein, 663 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHDEFERHAEGTFTSDVSSTLEGQAALEFIAWLVKGRG

SEQ ID NO: 997 - protein, 874 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGHDEFERHAEGTFTSDVSSTLEGQAALEFIAWLVKGRG

SEQ ID NO: 998 - protein, 902 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHDEFERHAEGTFTSDVSSTLEGQAALEFIAWLVKGRG

SEQ ID NO: 999 - protein, 913 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGHDEFERHAEGTFTSDVSSTLEGQAALEFIAWLVKGRG

SEQ ID NO: 1000 - protein, 902 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGHDEFERHAEGTFTSDVSSTLEGQAALEFIAWLVKGRG

SEQ ID NO: 1001 - protein, 913 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHDEFERHAEGTFTSDVSSTLEGQAALEFIAWLVKGRG

SEQ ID NO: 1002 - protein, 951 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHDEFERHAEGTFTSDVSSTLEGQAALEFIAWLVKGRG

SEQ ID NO: 1003 - protein, 962 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHDEFERHAEGTFTSDVSSTLEGQAALEFIAWLVKGRG

SEQ ID NO: 1004 - protein, 182 aa, Artificial Sequence
  Description of Artificial Sequence: Synthetic polypeptide
KCNTATCATNRLANFLVHSSNNFGPILPPTNVGSNTYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1005 - DNA, 546 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgccgaccaacgtgggcagcaacacctatggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1006 - protein, 326 aa, Artificial Sequence
  Description of Artificial Sequence: Synthetic polypeptide
KCNTATCATNRLANFLVHSSNNFGPILPPTNVGSNTYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1007 - DNA, 978 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgccgaccaacgtgggcagcaacacctatggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1008 - protein, 182 aa, Artificial Sequence
  Description of Artificial Sequence: Synthetic polypeptide
KCNTATCATNRLANFLVHSSNNFGPILPPTNVGSNTYGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1009 - DNA, 546 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgccgaccaacgtgggcagcaacacctatggtggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcacca

SEQ ID NO: 1010 - protein, 614 aa, Artificial Sequence
  Description of Artificial Sequence: Synthetic polypeptide
KCNTATCATNRLANFLVHSSNNFGPILPPTNVGSNTYGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1011 - DNA, 1842 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgccgaccaacgtgggcagcaacacctatggtggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctca

SEQ ID NO: 1012 - protein, 614 aa, Artificial Sequence
  Description of Artificial Sequence: Synthetic polypeptide
KCNTATCATNRLANFLVHSSNNFGPILPPTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1013 - DNA, 1842 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgccgaccaacgtgggcagcaacacctatggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 1014 - protein, 614 aa, Artificial Sequence
  Description of Artificial Sequence: Synthetic polypeptide
KCNTATCATNRLANFLVHSSNNFGPILPPTNVGSNTYGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1015 - DNA, 1842 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgccgaccaacgtgggcagcaacacctatggtggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctcca

SEQ ID NO: 1016 - protein, 874 aa, Artificial Sequence
  Description of Artificial Sequence: Synthetic polypeptide
KCNTATCATNRLANFLVHSSNNFGPILPPTNVGSNTYGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1017 - DNA, 2622 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgccgaccaacgtgggcagcaacacctatggtggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctca

SEQ ID NO: 1018 - protein, 902 aa, Artificial Sequence
  Description of Artificial Sequence: Synthetic polypeptide
KCNTATCATNRLANFLVHSSNNFGPILPPTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1019 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgccgaccaacgtgggcagcaacacctatggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1020 - protein, 913 aa, Artificial Sequence
  Description of Artificial Sequence: Synthetic polypeptide
  MOD_RES (468)..(470): Any amino acid
  MOD_RES (481)..(484): Any amino acid
KCNTATCATNRLANFLVHSSNNFGPILPPTNVGSNTYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1021 - DNA, 2739 bp, Artificial Sequence
  Description of Artificial Sequence: Synthetic polynucleotide
  modified_base (1401)..(1412): a, c, t, g, unknown or other
  modified_base (1444)..(1451): a, c, t, g, unknown or other
aaatgcaacaccgcgacctgcgcgaccaatcgcctggcgaactttctggtgcatagcagcaacaactttggcccgattctgccgccgaccaacgtgggcagcaacacctatggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 1022 - protein, 902 aa, Artificial Sequence
  Description of Artificial Sequence: Synthetic polypeptide
KCNTATCATNRLANFLVHSSNNFGPILPPTNVGSNTYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1023 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgccgaccaacgtgggcagcaacacctatggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 1024 - protein, 913 aa, Artificial Sequence
  Description of Artificial Sequence: Synthetic polypeptide
KCNTATCATNRLANFLVHSSNNFGPILPPTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1025 - DNA, 2739 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgccgaccaacgtgggcagcaacacctatggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 1026 - protein, 1356 aa, Artificial Sequence
  Description of Artificial Sequence: Synthetic polypeptide
KCNTATCATNRLANFLVHSSNNFGPILPPTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1027 - DNA, 4068 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgccgaccaacgtgggcagcaacacctatggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 1028 - protein, 87 aa, Artificial Sequence
  Description of Artificial Sequence: Synthetic polypeptide
MAEPAGSPTSTEEGTPGSGTASSSPGSSTPSGATGSPGASPGTSSTGSPGKCNTATCATNRLANFLVHSSNNFGPILPPTNVGSNTY

SEQ ID NO: 1029 - DNA, 261 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1030 - protein, 87 aa, Artificial Sequence
  Description of Artificial Sequence: Synthetic polypeptide
MAEPAGSPTSTEEGASPGTSSTGSPGSSTPSGATGSPGSSTPSGATGSPGKCNTATCATNRLANFLVHSSNNFGPILPPTNVGSNTY

SEQ ID NO: 1031 - DNA, 261 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1032 - protein, 614 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGKCNTATCATNRLANFLVHSSNNFGPILPPTNVGSNTY

SEQ ID NO: 1033 - DNA, 1842 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctcaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1034 - protein, 614 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATNRLANFLVHSSNNFGPILPPTNVGSNTY

SEQ ID NO: 1035 - DNA, 1842 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1036 - protein, 614 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGKCNTATCATNRLANFLVHSSNNFGPILPPTNVGSNTY

SEQ ID NO: 1037 - DNA, 1842 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctccaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1038 - protein, 663 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATNRLANFLVHSSNNFGPILPPTNVGSNTY

SEQ ID NO: 1039 - DNA, 1989 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1040 - protein, 874 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGKCNTATCATNRLANFLVHSSNNFGPILPPTNVGSNTY

SEQ ID NO: 1041 - DNA, 2622 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctcaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1042 - protein, 902 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATNRLANFLVHSSNNFGPILPPTNVGSNTY

SEQ ID NO: 1043 - DNA, 2706 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1044 - protein, 913 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGKCNTATCATNRLANFLVHSSNNFGPILPPTNVGSNTY

SEQ ID NO: 1045 - DNA, 2739 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctccccaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1046 - protein, 902 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGKCNTATCATNRLANFLVHSSNNFGPILPPTNVGSNTY

SEQ ID NO: 1047 - DNA, 2706 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctccaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1048 - protein, 913 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATNRLANFLVHSSNNFGPILPPTNVGSNTY

SEQ ID NO: 1049 - DNA, 2739 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1050 - protein, 951 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATNRLANFLVHSSNNFGPILPPTNVGSNTY

SEQ ID NO: 1051 - DNA, 2853 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1052 - protein, 962 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATNRLANFLVHSSNNFGPILPPTNVGSNTY

SEQ ID NO: 1053 - DNA, 2886 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgaccaatcgcctggcgaactttctggtgcatagcagcaacaactttggcccgattctgccgccgaccaacgtgggcagcaacacctat

SEQ ID NO: 1054 - protein, 902 aa, Artificial Sequence
  Description of Artificial Sequence: Synthetic polypeptide
KCNTATCATNRLANFLVHSSNNFGGILPPTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1055 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcggtattctgccgccgaccaacgtgggcagcaacacctatggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1056 - protein, 913 aa, Artificial Sequence
  Description of Artificial Sequence: Synthetic polypeptide
  MOD_RES (468)..(470): Any amino acid
  MOD_RES (481)..(484): Any amino acid
KCNTATCATNRLANFLVHSSNNFGGILPPTNVGSNTYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1057 - DNA, 2739 bp, Artificial Sequence
  Description of Artificial Sequence: Synthetic polynucleotide
  modified_base (1401)..(1412): a, c, t, g, unknown or other
  modified_base (1444)..(1451): a, c, t, g, unknown or other
aaatgcaacaccgcgacctgcgcgaccaatcgcctggcgaactttctggtgcatagcagcaacaactttggcggtattctgccgccgaccaacgtgggcagcaacacctatggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 1058 - protein, 902 aa, Artificial Sequence
  Description of Artificial Sequence: Synthetic polypeptide
KCNTATCATNRLANFLVHSSNNFGGILPPTNVGSNTYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1059 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcggtattctgccgccgaccaacgtgggcagcaacacctatggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 1060 - protein, 913 aa, Artificial Sequence
  Description of Artificial Sequence: Synthetic polypeptide
KCNTATCATNRLANFLVHSSNNFGGILPPTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1061 - DNA, 2739 bp, Artificial Sequence
  Description of Artificial Sequence: Synthetic polynucleotide
aaatgcaacaccgcgacctgcgcgaccaatcgcctggcgaactttctggtgcatagcagcaacaactttggcggtattctgccgccgaccaacgtgggcagcaacacctatggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 1062 - protein, 902 aa, Artificial Sequence
  Description of Artificial Sequence: Synthetic polypeptide
KCNTATCATNRLANFLVHSSNNFGPILGPTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1063 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgggtccgaccaacgtgggcagcaacacctatggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1064 - protein, 913 aa, Artificial Sequence
  Description of Artificial Sequence: Synthetic polypeptide
  MOD_RES (468)..(470): Any amino acid
  MOD_RES (481)..(484): Any amino acid
KCNTATCATNRLANFLVHSSNNFGPILGPTNVGSNTYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1065 - DNA, 2739 bp, Artificial Sequence
  Description of Artificial Sequence: Synthetic polynucleotide
  modified_base (1401)..(1412): a, c, t, g, unknown or other
  modified_base (1444)..(1451): a, c, t, g, unknown or other
aaatgcaacaccgcgacctgcgcgaccaatcgcctggcgaactttctggtgcatagcagcaacaactttggcccgattctgggtccgaccaacgtgggcagcaacacctatggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 1066 - protein, 902 aa, Artificial Sequence
  Description of Artificial Sequence: Synthetic polypeptide
KCNTATCATNRLANFLVHSSNNFGPILGPTNVGSNTYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1067 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgggtccgaccaacgtgggcagcaacacctatggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 1068 - protein, 913 aa, Artificial Sequence
  Description of Artificial Sequence: Synthetic polypeptide
KCNTATCATNRLANFLVHSSNNFGPILGPTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1069 - DNA, 2739 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgggtccgaccaacgtgggcagcaacacctatggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 1070 - protein, 902 aa, Artificial Sequence
  Description of Artificial Sequence: Synthetic polypeptide
KCNTATCATNRLANFLVHSSNNFGPILPGTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1071 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgggtaccaacgtgggcagcaacacctatggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1072 - protein, 913 aa, Artificial Sequence
  Description of Artificial Sequence: Synthetic polypeptide
  MOD_RES (468)..(470): Any amino acid
  MOD_RES (481)..(484): Any amino acid
KCNTATCATNRLANFLVHSSNNFGPILPGTNVGSNTYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1073 - DNA, 2739 bp, Artificial Sequence
  Description of Artificial Sequence: Synthetic polynucleotide
  modified_base (1401)..(1412): a, c, t, g, unknown or other
  modified_base (1444)..(1451): a, c, t, g, unknown or other
aaatgcaacaccgcgacctgcgcgaccaatcgcctggcgaactttctggtgcatagcagcaacaactttggcccgattctgccgggtaccaacgtgggcagcaacacctatggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 1074 - protein, 902 aa, Artificial Sequence
  Description of Artificial Sequence: Synthetic polypeptide
KCNTATCATNRLANFLVHSSNNFGPILPGTNVGSNTYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1075 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgggtaccaacgtgggcagcaacacctatggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 1076 - protein, 913 aa, Artificial Sequence
  Description of Artificial Sequence: Synthetic polypeptide
KCNTATCATNRLANFLVHSSNNFGPILPGTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1077 - DNA, 2739 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgccgggtaccaacgtgggcagcaacacctatggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 1078 - protein, 902 aa, Artificial Sequence
  Description of Artificial Sequence: Synthetic polypeptide
KCNTATCATNRLANFLVHSSNNFGGILGPTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1079 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcggtattctgggtccgaccaacgtgggcagcaacacctatggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1080 - protein, 913 aa, Artificial Sequence
  Description of Artificial Sequence: Synthetic polypeptide
  MOD_RES (468)..(470): Any amino acid
  MOD_RES (481)..(484): Any amino acid
KCNTATCATNRLANFLVHSSNNFGGILGPTNVGSNTYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1081 - DNA, 2739 bp, Artificial Sequence
  Description of Artificial Sequence: Synthetic polynucleotide
  modified_base (1401)..(1412): a, c, t, g, unknown or other
  modified_base (1444)..(1451): a, c, t, g, unknown or other
aaatgcaacaccgcgacctgcgcgaccaatcgcctggcgaactttctggtgcatagcagcaacaactttggcggtattctgggtccgaccaacgtgggcagcaacacctatggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 1082 - protein, 902 aa, Artificial Sequence
  Description of Artificial Sequence: Synthetic polypeptide
KCNTATCATNRLANFLVHSSNNFGGILGPTNVGSNTYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1083 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcggtattctgggtccgaccaacgtgggcagcaacacctatggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 1084 - protein, 913 aa, Artificial Sequence
  Description of Artificial Sequence: Synthetic polypeptide
KCNTATCATNRLANFLVHSSNNFGGILGPTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1085 - DNA, 2739 bp, Artificial Sequence
  Description of Artificial Sequence: Synthetic polynucleotide
aaatgcaacaccgcgacctgcgcgaccaatcgcctggcgaactttctggtgcatagcagcaacaactttggcggtattctgggtccgaccaacgtgggcagcaacacctatggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 1086 - protein, 902 aa, Artificial Sequence
  Description of Artificial Sequence: Synthetic polypeptide
KCNTATCATNRLANFLVHSSNNFGPILGGTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1087 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgggtggtaccaacgtgggcagcaacacctatggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1088 - protein, 913 aa, Artificial Sequence
  Description of Artificial Sequence: Synthetic polypeptide
  MOD_RES (468)..(470): Any amino acid
  MOD_RES (481)..(484): Any amino acid
KCNTATCATNRLANFLVHSSNNFGPILGGTNVGSNTYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1089 - DNA, 2739 bp, Artificial Sequence
  Description of Artificial Sequence: Synthetic polynucleotide
  modified_base (1401)..(1412): a, c, t, g, unknown or other
  modified_base (1444)..(1451): a, c, t, g, unknown or other
aaatgcaacaccgcgacctgcgcgaccaatcgcctggcgaactttctggtgcatagcagcaacaactttggcccgattctgggtggtaccaacgtgggcagcaacacctatggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 1090 - protein, 902 aa, Artificial Sequence
  Description of Artificial Sequence: Synthetic polypeptide
KCNTATCATNRLANFLVHSSNNFGPILGGTNVGSNTYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1091 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgggtggtaccaacgtgggcagcaacacctatggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 1092 - protein, 913 aa, Artificial Sequence
  Description of Artificial Sequence: Synthetic polypeptide
KCNTATCATNRLANFLVHSSNNFGPILGGTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1093 - DNA, 2739 bp, Artificial Sequence
  Description of Artificial Sequence: Synthetic polynucleotide
aaatgcaacaccgcgacctgcgcgaccaatcgcctggcgaactttctggtgcatagcagcaacaactttggcccgattctgggtggtaccaacgtgggcagcaacacctatggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 1094 - protein, 902 aa, Artificial Sequence
  Description of Artificial Sequence: Synthetic polypeptide
KCNTATCATNRLANFLVHSSNNFGGILPGTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1095 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcggtattctgccgggtaccaacgtgggcagcaacacctatggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1096 - protein, 913 aa, Artificial Sequence
  Description of Artificial Sequence: Synthetic polypeptide
  MOD_RES (468)..(470): Any amino acid
  MOD_RES (481)..(484): Any amino acid
KCNTATCATNRLANFLVHSSNNFGGILPGTNVGSNTYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1097 - DNA, 2739 bp, Artificial Sequence
  Description of Artificial Sequence: Synthetic polynucleotide
  modified_base (1401)..(1412): a, c, t, g, unknown or other
  modified_base (1444)..(1451): a, c, t, g, unknown or other
aaatgcaacaccgcgacctgcgcgaccaatcgcctggcgaactttctggtgcatagcagcaacaactttggcggtattctgccgggtaccaacgtgggcagcaacacctatggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 1098 - protein, 902 aa, Artificial Sequence
  Description of Artificial Sequence: Synthetic polypeptide
KCNTATCATNRLANFLVHSSNNFGGILPGTNVGSNTYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1099 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcggtattctgccgggtaccaacgtgggcagcaacacctatggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 1100 - protein, 913 aa, Artificial Sequence
  Description of Artificial Sequence: Synthetic polypeptide
KCNTATCATNRLANFLVHSSNNFGGILPGTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1101 - DNA, 2739 bp, Artificial Sequence
  Description of Artificial Sequence: Synthetic polynucleotide
aaatgcaacaccgcgacctgcgcgaccaatcgcctggcgaactttctggtgcatagcagcaacaactttggcggtattctgccgggtaccaacgtgggcagcaacacctatggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 1102 - protein, 902 aa, Artificial Sequence
  Description of Artificial Sequence: Synthetic polypeptide
KCNTATCATNRLANFLVHSSNNFGGILGGTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1103 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcggtattctgggtggtaccaacgtgggcagcaacacctatggtggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1104 - protein, 913 aa, Artificial Sequence
  Description of Artificial Sequence: Synthetic polypeptide
  MOD_RES (468)..(470): Any amino acid
  MOD_RES (481)..(484): Any amino acid
KCNTATCATNRLANFLVHSSNNFGGILGGTNVGSNTYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1105 - DNA, 2739 bp, Artificial Sequence
  Description of Artificial Sequence: Synthetic polynucleotide
  modified_base (1401)..(1412): a, c, t, g, unknown or other
  modified_base (1444)..(1451): a, c, t, g, unknown or other
aaatgcaacaccgcgacctgcgcgaccaatcgcctggcgaactttctggtgcatagcagcaacaactttggcggtattctgggtggtaccaacgtgggcagcaacacctatggtggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 1106 - protein, 902 aa, Artificial Sequence
  Description of Artificial Sequence: Synthetic polypeptide
KCNTATCATNRLANFLVHSSNNFGGILGGTNVGSNTYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1107 - DNA, 2706 bp, Artificial Sequence
  Description of Artificial Sequence: Synthetic polynucleotide
aaatgcaacaccgcgacctgcgcgaccaatcgcctggcgaactttctggtgcatagcagcaacaactttggcggtattctgggtggtaccaacgtgggcagcaacacctatggtggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 1108 - protein, 913 aa, Artificial Sequence
  Description of Artificial Sequence: Synthetic polypeptide
KCNTATCATNRLANFLVHSSNNFGGILGGTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1109 - DNA, 2739 bp, Artificial Sequence
  Description of Artificial Sequence: Synthetic polynucleotide
aaatgcaacaccgcgacctgcgcgaccaatcgcctggcgaactttctggtgcatagcagcaacaactttggcggtattctgggtggtaccaacgtgggcagcaacacctatggtggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 1110 - protein, 224 aa, Artificial Sequence
  Description of Artificial Sequence: Synthetic polypeptide
MAEPAGSPTSTEEGTPGSGTASSSPGSSTPSGATGSPGASPGTSSTGSPGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1111 - DNA, 672 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1112 - protein, 224 aa, Artificial Sequence
  Description of Artificial Sequence: Synthetic polypeptide
MAEPAGSPTSTEEGASPGTSSTGSPGSSTPSGATGSPGSSTPSGATGSPGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1113 - DNA, 672 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1114 - protein, 751 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1115 - DNA, 2253 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctcaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1116 - protein, 751 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1117 - DNA, 2253 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1118 - protein, 751 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1119 - DNA, 2253 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctccaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1120 - protein, 800 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1121 - DNA, 2400 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1122 - protein, 1011 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1123 - DNA, 3033 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctcaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1124 - protein, 1039 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1125 - DNA, 3117 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1126 - protein, 1050 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1127 - DNA, 3150 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctccccaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1128 - protein, 1039 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1129 - DNA, 3117 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctccaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1130 - protein, 1050 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1131 - DNA, 3150 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1132 - protein, 1088 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1133 - DNA, 3264 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1134 - protein, 1099 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1135 - DNA, 3297 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcactctcagggtacgttcacctccgactactccaaatacctggattctcgtcgcgctcaagatttcgttcagtggctgatgaacactggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1136 - protein, 368 aa, Artificial Sequence
  Description of Artificial Sequence: Synthetic polypeptide
MAEPAGSPTSTEEGTPGSGTASSSPGSSTPSGATGSPGASPGTSSTGSPGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1137 - DNA, 1104 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1138 - protein, 368 aa, Artificial Sequence
  Description of Artificial Sequence: Synthetic polypeptide
MAEPAGSPTSTEEGASPGTSSTGSPGSSTPSGATGSPGSSTPSGATGSPGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1139 - DNA, 1104 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1140 - protein, 895 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1141 - DNA, 2685 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctcaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1142 - protein, 895 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1143 - DNA, 2685 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1144 - protein, 895 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1145 - DNA, 2685 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctccaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1146 - protein, 944 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1147 - DNA, 2832 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1148 - protein, 1155 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1149 - DNA, 3465 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctcaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1150 - protein, 1183 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1151 - DNA, 3549 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1152 - protein, 1194 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1153 - DNA, 3582 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctccccaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1154 - protein, 1183 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1155 - DNA, 3549 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctccaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1156 - protein, 1194 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1157 - DNA, 3582 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1158 - protein, 1232 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1159 - DNA, 3696 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1160 - protein, 1243 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1161 - DNA, 3729 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcactctcagggtacgttcacctccgactactccaaatacctggattctcgtcgcgctcaagatttcgttcagtggctgatgaacactggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1162 - protein, 234 aa, Artificial Sequence
  Description of Artificial Sequence: Synthetic polypeptide
MAEPAGSPTSTEEGTPGSGTASSSPGSSTPSGATGSPGASPGTSSTGSPGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1163 - DNA, 702 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1164 - protein, 234 aa, Artificial Sequence
  Description of Artificial Sequence: Synthetic polypeptide
MAEPAGSPTSTEEGASPGTSSTGSPGSSTPSGATGSPGSSTPSGATGSPGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1165 - DNA, 702 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1166 - protein, 761 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1167 - DNA, 2283 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctcaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1168 - protein, 761 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1169 - DNA, 2283 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1170 - protein, 761 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1171 - DNA, 2283 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctccaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1172 - protein, 810 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1173 - DNA, 2430 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1174 - protein, 1021 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1175 - DNA, 3063 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctcaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1176 - protein, 1049 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1177 - DNA, 3147 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1178 - protein, 1060 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1179 - DNA, 3180 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctccccaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1180 - protein, 1049 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1181 - DNA, 3147 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctccaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1182 - protein, 1060 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1183 - DNA, 3180 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1184 - protein, 1098 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1185 - DNA, 3294 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1186 - protein, 1109 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1187 - DNA, 3327 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1188 - protein, 378 aa, Artificial Sequence
  Description of Artificial Sequence: Synthetic polypeptide
MAEPAGSPTSTEEGTPGSGTASSSPGSSTPSGATGSPGASPGTSSTGSPGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1189 - DNA, 1134 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1190 - protein, 378 aa, Artificial Sequence
  Description of Artificial Sequence: Synthetic polypeptide
MAEPAGSPTSTEEGASPGTSSTGSPGSSTPSGATGSPGSSTPSGATGSPGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1191 - DNA, 1134 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1192 - protein, 905 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1193 - DNA, 2715 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtcctggtgagtcttcaggtgaatctccaggtggctctagcggttccgagtcaggtagcgaaggttcttctggtcctggcgagtcctcaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1194 - protein, 905 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1195 - DNA, 2715 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1196 - protein, 905 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1197 - DNA, 2715 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctccaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1198 - protein, 954 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1199 - DNA, 2862 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1200 - protein, 1165 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1201 - DNA, 3495 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtcaggttctggtggcgaaccttccgagtctggtagctcaggtgaatctccgggtggttctagcggttccgagtcaggtgaatctccgggtggttccagcggttctgagtcaggttcctccgaaagcggttcttctgagggcggtccaggttcctccgaaagcggttcttccgagggcggtccaggttcttctgaaagcggttcttccgagggcggtccaggtgaatctcctggtggttccagcggttccgagtcaggtgaatctccaggtggctctagcggttccgagtcaggtgaatctcctggtggttctagcggttctgaatcaggttcctccgaaagcggttcttctgagggcggtccaggttcctccgaaagcggttcttccgagggcggtccaggttcttctgaaagcggttcttccgagggcggtccaggttcctctgaaagcggttcttctgagggcggtccaggttcttccgaaagcggttcttccgagggcggtccaggttcttccgaaagcggttcttctgaaggcggtccaggttctggtggcgaaccgtccgagtctggtagctcaggtgaatctccgggtggctctagcggttccgagtcaggtgaatctcctggtggttccagcggttccgagtcaggttccggtggcgaaccgtccgaatctggtagctcaggtagcgaaggttcttctggtccaggcgaatcttcaggttcctctgaaagcggttcttctgagggcggtccaggttccggtggcgaaccgtccgaatctggtagctcaggtagcgaaggttcttctggtccaggcgaatcttcaggttcctctgaaagcggttcttctgagggcggtccaggttccggtggcgaaccttccgaatctggtagctcaggtgaatctccgggtggttctagcggttctgagtcaggttctggtggtgaaccttccgagtctggtagctcaggttctggtggcgaaccatccgagtctggtagctcaggttcttccgaaagcggttcttccgaaggcggtccaggttctggtggtgaaccgtccgaatctggtagctcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggtgaatcttcaggtagcgaaggttcttctggtcctggtgaatcctcaggttccggtggcgaaccatctgaatctggtagctcaggttcctctgaaagcggttcttccgaaggtggtccaggttcctctgaaagcggttcttctgagggtggtccaggtgaatctccgggtggctccagcggttccgagtcaggttctggtggcgaaccatccgaatctggtagctcaggtagcgaaggttcttctggtcctggcgaatcttcaggtgaatctccaggtggctctagcggttccgaatcaggtagcgaaggttcttccggtccaggttcctctgaaagcggttcttctgagggcggtccaggttctggtggcgaaccatctgaatctggtagctcaggtagcgaaggttcttccggtccgggtgaatcttcaggtagcgaaggttcttccggtccaggtgaatcttcaggtagcgaaggttcttctggtcctggtgaatcctcaggttccggtggcgaaccatctgaatctggtagctcaggttctggtggcgaaccatccgaatctggtagctcaggtgaatctccgggtggctccagcggttctgaatcaggtgaatctcctggtggctccagcggttctgagtcaggttctggtggcgaaccatccgaatctggtagctcaggtagcgaaggttcttctggtcctggcgaatcttcaggtgaatctccaggtggctctagcggttccgaatcaggttcctctgaaagcggttcttctgagggcggtccaggttcttccgaaagcggttcttccgagggcggtccaggttcttccgaaagcggttcttctgaaggcggtccaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggttcctccgaaagcggttcttctgaaggtggtccaggtgaatctccaggtggttctagcggttctgaatcaggttctggtggcgaaccgtccgaatctggtagctcaggtgaatctcctggtggttccagcggttccgagtcaggttctggtggcgaaccttccgaatctggtagctcaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1202 - protein, 1193 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1203 - DNA, 3579 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1204 - protein, 1204 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1205 - DNA, 3612 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctccccaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1206 - protein, 1193 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1207 - DNA, 3579 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctccaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1208 - protein, 1204 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1209 - DNA, 3612 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1210 - protein, 1242 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1211 - DNA, 3726 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1212 - protein, 1253 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1213 - DNA, 3759 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1214 - protein, 1096 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1215 - DNA, 3288 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1216 - protein, 1251 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1217 - DNA, 3753 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgacccagcgcctggcgaactttctggtgcatagcagcaacaactttggcgcgattctgtcctctaccaacgtgggcagcaacacctatggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1218 - protein, 1096 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGPILPPTNVGSNTYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1219 - DNA, 3177 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1220 - protein, 1251 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGPILPPTNVGSNTYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1221 - DNA, 3642 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1222 - protein, 1096 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHDEFERHAEGTFTSDVSSTLEGQAALEFIAWLVKGRGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1223 - DNA, 3177 bp, Artificial Sequence; identical to SEQ ID NO: 1219
  Description of Artificial Sequence: Synthetic polynucleotide

SEQ ID NO: 1224 - protein, 1244 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHAEGTFTSDVSSYLEGQAALEFIAWLVKGRGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1225 - DNA, 3642 bp, Artificial Sequence; identical to SEQ ID NO: 1221
  Description of Artificial Sequence: Synthetic polynucleotide

SEQ ID NO: 1226 - protein, 1096 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATNRLANFLVHSSNNFGPILPPTNVGSNTYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1227 - DNA, 3288 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgaccaatcgcctggcgaactttctggtgcatagcagcaacaactttggcccgattctgccgccgaccaacgtgggcagcaacacctatggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1228 - protein, 1251 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATNRLANFLVHSSNNFGGILPPTNVGSNTYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1229 - DNA, 3753 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgaccaatcgcctggcgaactttctggtgcatagcagcaacaactttggcggtattctgccgccgaccaacgtgggcagcaacacctatggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1230 - protein, 1096 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATNRLANFLVHSSNNFGPILGPTNVGSNTYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1231 - DNA, 3288 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgaccaatcgcctggcgaactttctggtgcatagcagcaacaactttggcccgattctgggtccgaccaacgtgggcagcaacacctatggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1232 - protein, 1251 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATNRLANFLVHSSNNFGPILPGTNVGSNTYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1233 - DNA, 3753 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgaccaatcgcctggcgaactttctggtgcatagcagcaacaactttggcccgattctgccgggtaccaacgtgggcagcaacacctatggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1234 - protein, 1096 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATNRLANFLVHSSNNFGGILGPTNVGSNTYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1235 - DNA, 3288 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgaccaatcgcctggcgaactttctggtgcatagcagcaacaactttggcggtattctgggtccgaccaacgtgggcagcaacacctatggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1236 - protein, 1251 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATNRLANFLVHSSNNFGPILGGTNVGSNTYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1237 - DNA, 3753 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgaccaatcgcctggcgaactttctggtgcatagcagcaacaactttggcccgattctgggtggtaccaacgtgggcagcaacacctatggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1238 - protein, 1096 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATNRLANFLVHSSNNFGGILPGTNVGSNTYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1239 - DNA, 3288 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgaccaatcgcctggcgaactttctggtgcatagcagcaacaactttggcggtattctgccgggtaccaacgtgggcagcaacacctatggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1240 - protein, 1251 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATNRLANFLVHSSNNFGGILGGTNVGSNTYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1241 - DNA, 3753 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgaccaatcgcctggcgaactttctggtgcatagcagcaacaactttggcggtattctgggtggtaccaacgtgggcagcaacacctatggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1242 - protein, 1109 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPSGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1243 - DNA, 3327 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtctgaccccgcgcagcctgctggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1244 - protein, 1109 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPSGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1245 - DNA, 3327 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggcggcaaactgacccgcgtggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1246 - protein, 1109 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPSGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1247 - DNA, 3327 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggcggcctgggcccggtgagcggcgtgccgggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1248 - protein, 1109 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPSGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1249 - DNA, 3327 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtgcgccgctgggcctgcgcctgcgcggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1250 - protein, 1253 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPSGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1251 - DNA, 3759 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtctgaccccgcgcagcctgctggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1252 - protein, 1253 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPSGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1253 - DNA, 3759 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggcggcaaactgacccgcgtggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1254 - protein, 1253 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPSGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1255 - DNA, 3759 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggcggcctgggcccggtgagcggcgtgccgggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1256 - protein, 1253 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPSGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1257 - DNA, 3759 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtgcgccgctgggcctgcgcctgcgcggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1258 - protein, 1120 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPSGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1259 - DNA, 3360 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtctgaccccgcgcagcctgctggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1260 - protein, 1120 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPSGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1261 - DNA, 3360 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggcggcaaactgacccgcgtggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1262 - protein, 1120 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPSGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1263 - DNA, 3360 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggcggcctgggcccggtgagcggcgtgccgggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1264 - protein, 1120 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPSGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1265 - DNA, 3360 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtgcgccgctgggcctgcgcctgcgcggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1266 - protein, 1264 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPSGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1267 - DNA, 3792 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtctgaccccgcgcagcctgctggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1268 - protein, 1264 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPSGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1269 - DNA, 3792 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggcggcaaactgacccgcgtggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1270 - protein, 1264 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPSGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1271 - DNA, 3792 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggcggcctgggcccggtgagcggcgtgccgggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1272 - protein, 1264 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPSGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1273 - DNA, 3792 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtgcgccgctgggcctgcgcctgcgcggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1274 - protein, 821 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPSGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1275 - DNA, 2463 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtctgaccccgcgcagcctgctggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1276 - protein, 821 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPSGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1277 - DNA, 2463 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggcggcaaactgacccgcgtggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1278 - protein, 821 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPSGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1279 - DNA, 2463 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggcggcctgggcccggtgagcggcgtgccgggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1280 - protein, 821 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPSGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1281 - DNA, 2463 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtgcgccgctgggcctgcgcctgcgcggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1282 - protein, 965 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPSGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1283 - DNA, 2895 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtctgaccccgcgcagcctgctggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1284 - protein, 965 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPSGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1285 - DNA, 2895 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggcggcaaactgacccgcgtggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1286 - protein, 965 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPSGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1287 - DNA, 2895 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtggcggcctgggcccggtgagcggcgtgccgggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1288 - protein, 965 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPSGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1289 - DNA, 2895 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtcacggtgagggcactttcacgtccgacctgtccaagcagatggaggaagaagcggttcgcctcttcatcgagtggctgaaaaacggtggtccgtcctctggtgcgcctccgccgtctggtgcgccgctgggcctgcgcctgcgcggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1290 - protein, 1107 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTYGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1291 - DNA, 3321 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtctgaccccgcgcagcctgctggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1292 - protein, 1107 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTYGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1293 - DNA, 3321 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtggcggcaaactgacccgcgtggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1294 - protein, 1107 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTYGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1295 - DNA, 3321 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtggcggcctgggcccggtgagcggcgtgccgggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1296 - protein, 1107 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTYGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1297 - DNA, 3321 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtgcgccgctgggcctgcgcctgcgcggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1298 - protein, 1251 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTYGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1299 - DNA, 3753 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtctgaccccgcgcagcctgctggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1300 - protein, 1251 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTYGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1301 - DNA, 3753 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtggcggcaaactgacccgcgtggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1302 - protein, 1251 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTYGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1303 - DNA, 3753 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtggcggcctgggcccggtgagcggcgtgccgggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1304 - protein, 1251 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTYGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1305 - DNA, 3753 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtgcgccgctgggcctgcgcctgcgcggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1306 - protein, 1118 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTYGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1307 - DNA, 3354 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgacccagcgcctggcgaactttctggtgcatagcagcaacaactttggcgcgattctgtcctctaccaacgtgggcagcaacacctatggtctgaccccgcgcagcctgctggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1308 - protein, 1118 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTYGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1309 - DNA, 3354 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgacccagcgcctggcgaactttctggtgcatagcagcaacaactttggcgcgattctgtcctctaccaacgtgggcagcaacacctatggtggcggcaaactgacccgcgtggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1310 - protein, 1118 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTYGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1311 - DNA, 3354 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgacccagcgcctggcgaactttctggtgcatagcagcaacaactttggcgcgattctgtcctctaccaacgtgggcagcaacacctatggtggcggcctgggcccggtgagcggcgtgccgggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1312 - protein, 1118 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTYGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1313 - DNA, 3354 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgacccagcgcctggcgaactttctggtgcatagcagcaacaactttggcgcgattctgtcctctaccaacgtgggcagcaacacctatggtgcgccgctgggcctgcgcctgcgcggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1314 - protein, 1262 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTYGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1315 - DNA, 3786 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgacccagcgcctggcgaactttctggtgcatagcagcaacaactttggcgcgattctgtcctctaccaacgtgggcagcaacacctatggtctgaccccgcgcagcctgctggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1316 - protein, 1262 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTYGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1317 - DNA, 3786 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgacccagcgcctggcgaactttctggtgcatagcagcaacaactttggcgcgattctgtcctctaccaacgtgggcagcaacacctatggtggcggcaaactgacccgcgtggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1318 - protein, 1262 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTYGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1319 - DNA, 3786 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgacccagcgcctggcgaactttctggtgcatagcagcaacaactttggcgcgattctgtcctctaccaacgtgggcagcaacacctatggtggcggcctgggcccggtgagcggcgtgccgggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1320 - protein, 1262 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTYGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1321 - DNA, 3786 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcaccaggtaaatgcaacaccgcgacctgcgcgacccagcgcctggcgaactttctggtgcatagcagcaacaactttggcgcgattctgtcctctaccaacgtgggcagcaacacctatggtgcgccgctgggcctgcgcctgcgcggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1322 - protein, 819 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGAILSSTNVGSNTYGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1323 - DNA, 2457 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtctgaccccgcgcagcctgctggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1324 - protein, 819 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGAILSSTNVGSNTYGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1325 - DNA, 2457 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtggcggcaaactgacccgcgtggtgggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1326 - protein, 819 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGAILSSTNVGSNTYGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1327 - DNA, 2457 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtggcggcctgggcccggtgagcggcgtgccgggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1328 - protein, 819 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGAILSSTNVGSNTYGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1329 - DNA, 2457 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtgcgccgctgggcctgcgcctgcgcggcggcggtggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 1330 - protein, 963 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGAILSSTNVGSNTYGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1331 - DNA, 2889 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtctgaccccgcgcagcctgctggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1332 - protein, 963 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGAILSSTNVGSNTYGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1333 - DNA, 2889 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtggcggcaaactgacccgcgtggtgggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1334 - protein, 963 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGAILSSTNVGSNTYGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1335 - DNA, 2889 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtggcggcctgggcccggtgagcggcgtgccgggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1336 - protein, 963 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGAILSSTNVGSNTYGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1337 - DNA, 2889 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtaaatgcaacaccgcgacctgcgcgacccagcgcctggcgaactttctggtgcatagcagcaacaactttggcgcgattctgtcctctaccaacgtgggcagcaacacctatggtgcgccgctgggcctgcgcctgcgcggcggcggtggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 1338 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngctggctctccaacctccactgaggaaggt

SEQ ID NO: 1339 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXAGSPTSTEE

SEQ ID NO: 1340 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngaaagcgcaacccctgagtccggtccaggt

SEQ ID NO: 1341 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXESATPESGP

SEQ ID NO: 1342 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvnactccgtctggtgctaccggttccccaggt

SEQ ID NO: 1343 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXTPSGATGSP

What is claimed is:

1. An isolated fusion protein, comprising a glucose regulating peptide (GP) that is at least 90% identical to SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, or SEQ ID NO:11, wherein said glucose regulating peptide is linked to an extended recombinant polypeptide (XTEN) of at least about 200 amino acids residues, wherein the XTEN is characterized in that:
   (a) the XTEN sequence comprises at least about 200 contiguous amino acids that exhibits at least 90% sequence identity to a comparable length of an amino acid sequence selected from the group consisting of the sequences of SEQ ID NOS: 191-207;
   (b) the XTEN sequence lacks a predicted T-cell epitope when analyzed by TEPITOPE algorithm, wherein the TEPITOPE algorithm prediction for epitopes within the XTEN sequence is based on a score of −9 or greater;
   (c) the XTEN sequence has a subsequence score of less than 10; and
   (d) the sum of glycine (G), alanine (A), serine (S), threonine (T), glutamate (E) and proline (P) residues constitutes more than about 90% of the total number of amino acid residues of the XTEN.

2. The isolated fusion protein of claim 1, further comprising a second XTEN sequence, and wherein the fusion protein adopts a multiple-XTEN configuration shown in Table 7.

3. The isolated fusion protein of claim 1, wherein the glucose regulating peptide and the XTEN are linked via a spacer, wherein the spacer sequence comprises between 1 to about 50 amino acid residues, and wherein the spacer optionally comprises a cleavage sequence.

4. The isolated fusion protein of claim 1, wherein the fusion protein binds to the same target receptor of the corresponding native glucose regulating peptide that lacks the XTEN, and wherein said fusion protein retains at least about 0.1% to about 30% or greater of the binding affinity of the corresponding glucose regulating peptide that lacks the XTEN.

5. An isolated fusion protein, comprising an amino acid sequence that has at least 90% sequence identity to an amino acid sequence selected from SEQ ID NOS: 808, 814, 816, 820, 884, 890, 896, 980, 983, 986, 988, and 989.

6. A pharmaceutical composition comprising the isolated fusion protein of claim 1 or 5, and a pharmaceutically acceptable carrier.

7. The isolated protein of claim 1 that is configured according to formula I:

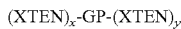
$$(XTEN)_x\text{-}GP\text{-}(XTEN)_y \qquad (I)$$

wherein independently for each occurrence:
(a) x is either 0 or 1; and
(b) y is either 0 or 1, wherein x+y≥1.

8. The isolated fusion protein of claim 1, wherein the XTEN is fused to the glucose regulating peptide on an N- or C-terminus of the glucose regulating peptide.

9. An isolated fusion protein, comprising a glucose regulating peptide that is at least 90% identical to SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, or SEQ ID NO:11 and a first and a second XTEN that each are:
(a) at least 90% identical to one or more amino acid sequences selected from selected from the group consisting of the sequences of SEQ ID NOS: 191-207;
(b) the XTEN sequence lacks a predicted T-cell epitope when analyzed by TEPITOPE algorithm, wherein the TEPITOPE algorithm prediction for epitopes within the XTEN sequence is based on a score of −9 or greater;
(c) the XTEN sequence has a subsequence score of less than 10; and
(d) the sum of glycine (G), alanine (A), serine (S), threonine (T), glutamate (E) and proline (P) residues constitutes more than about 90% of the total number of amino acid residues of the XTEN.

10. The isolated fusion protein of claim 1, characterized in that:
(i) the fusion protein has a longer terminal half-life when administered to a subject compared to the corresponding glucose regulating peptide that lacks the XTEN when administered to a subject at a comparable molar dose;
(ii) when a smaller molar amount of the fusion protein is administered to a subject in comparison to the corresponding glucose regulating peptide that lacks the XTEN administered to a subject under an otherwise equivalent dose regimen, the fusion protein achieves a comparable area under the curve (AUC) as the corresponding glucose regulating peptide that lacks the XTEN;
(iii) when a smaller molar amount of the fusion protein is administered to a subject in comparison to the corresponding glucose regulating peptide that lacks the XTEN administered to a subject under an otherwise equivalent dose regimen, the fusion protein achieves a comparable therapeutic effect as the corresponding glucose regulating peptide that lacks the XTEN;
(iv) when the fusion protein is administered to a subject less frequently in comparison to the corresponding glucose regulating peptide that lacks the XTEN administered to a subject using an otherwise equivalent molar amount, the fusion protein achieves a comparable area under the curve (AUC) as the corresponding glucose regulating peptide that lacks the XTEN;
(v) when the fusion protein is administered to a subject less frequently in comparison to the corresponding glucose regulating peptide that lacks the XTEN administered to a subject using an otherwise equivalent molar amount, the fusion protein achieves a comparable therapeutic effect as the corresponding glucose regulating peptide that lacks the XTEN;
(vi) when an accumulatively smaller molar amount of the fusion protein is administered to a subject in comparison to the corresponding glucose regulating peptide that lacks the XTEN administered to a subject under an otherwise equivalent dose period, the fusion protein achieves comparable area under the curve (AUC) as the corresponding glucose regulating peptide that lacks the XTEN; or
(vii) when an accumulatively smaller molar amount of the fusion protein is administered to a subject in comparison to the corresponding glucose regulating peptide that lacks the XTEN administered to a subject under an otherwise equivalent dose period, the fusion protein achieves comparable therapeutic effect as the corresponding glucose regulating peptide that lacks the XTEN.

11. A method of producing a fusion protein comprising a glucose regulating peptide fused to one or more extended recombinant polypeptides (XTEN), comprising:
(a) providing a host cell comprising a recombinant polynucleotide molecule encoding the fusion protein of claim 1 or 5;
(b) culturing the host cell under conditions permitting the expression of the fusion protein; and
(c) recovering the fusion protein.

12. The method of claim 11, wherein the glucose regulating peptide of the fusion protein has at least 90% sequence identity to:
(a) human glucose regulating peptide; or
(b) a sequence selected from SEQ ID NOS: 2-8 and 10.

13. The method of claim 11, wherein the one or more XTEN of the expressed fusion protein has at least 90% sequence identity to a sequence selected from the group consisting of the sequences of SEQ ID NOS: 191-207.

14. The method of claim 11, wherein the polynucleotide molecule encoding the fusion protein comprises a nucleic acid sequence exhibiting at least 90% sequence identity to SEQ ID NO: 809, SEQ ID NO: 815, SEQ ID NO: 821, SEQ ID NO: 883, SEQ ID NO: 885, SEQ ID NO: 891, SEQ ID NO: 897, or SEQ ID NO: 903.

15. The method of claim 11, wherein the polynucleotide is codon optimized for enhanced expression of said fusion protein in the host cell.

16. The method of claim 11, wherein the host cell is a prokaryotic cell.

17. The method of claim 11, wherein the isolated fusion protein is recovered from the host cell cytoplasm with at least about 20% greater water solubility compared to the glucose regulating peptide not fused to XTEN.

18. An isolated nucleic acid comprising a nucleotide sequence encoding the fusion protein of claim 1 or the complement thereof.

19. An expression vector comprising the nucleic acid of claim 18.

20. An isolated host cell comprising the nucleic acid of claim 18, wherein the host cell is a prokaryotic host cell.

21. A method of treating a glucose regulating peptide (GP) related condition in a subject, comprising administering to the subject a therapeutically effective amount of the fusion protein of claim 1.

22. The method of claim 21, wherein the glucose regulating peptide related condition is selected from juvenile diabetes, type I diabetes, type II diabetes, obesity, acute hypoglycemia, acute hyperglycemia, nocturnal hypoglycemia, chronic hyperglycemia, glucagonomas, secretory disorders of the airway, arthritis, osteoporosis, central nervous system disease, restenosis, neurodegenerative disease, renal failure, congestive heart failure, nephrotic syndrome, cirrhosis, pulmonary edema, hypertension, stroke, irritable bowel syndrome, myocardial infarction, acute coronary syndrome, post-surgical catabolic changes, hibernating myocardium, diabetic cardiomyopathy, insufficient urinary sodium excretion, excessive urinary potassium concentration, polycystic ovary syndrome, respiratory distress, nephropathy, left ventricular systolic dysfunction, diarrhea, postoperative dumping syndrome, critical illness polyneuropathy (CIPN), dyslipidemia, organ tissue injury caused by reperfusion of blood flow following ischemia, and coronary heart disease risk factor (CHDRF) syndrome.

23. The method of claim 21, wherein the therapeutically effective amount results in maintaining blood concentrations of the fusion protein within a therapeutic window for the fusion protein at least three-fold longer compared to the corresponding native glucose regulating peptide that lacks the XTEN administered at a therapeutically effective amount to a subject.

24. The method of claim 21, wherein administration of two or more consecutive doses of a therapeutically effective amount of the fusion protein administered using a therapeutically effective dose regimen to a subject results in a gain in time between consecutive $C_{max}$ peaks and/or $C_{min}$ troughs for blood levels of the fusion protein compared to the corresponding glucose regulating peptide not linked to XTEN and administered to a subject using a therapeutically effective dose regimen established for the GP.

25. The method of claim 21, wherein
   (i) a smaller molar amount of the fusion protein is administered to a subject in comparison to the corresponding glucose regulating peptide that lacks the XTEN administered to a subject under an otherwise equivalent dose regimen, and the fusion protein achieves a comparable therapeutic effect as the corresponding glucose regulating peptide that lacks the XTEN;
   (ii) the fusion protein is administered less frequently to a subject in comparison to the corresponding glucose regulating peptide that lacks the XTEN administered to a subject using an otherwise equivalent molar dose, and the fusion protein achieves a comparable therapeutic effect as the corresponding glucose regulating peptide that lacks the XTEN; or
   (iii) an accumulatively smaller molar amount of the fusion protein is administered to a subject in comparison to the corresponding glucose regulating peptide that lacks the XTEN administered to a subject under the otherwise equivalent dose period, the fusion protein achieves a comparable therapeutic effect as the corresponding glucose regulating peptide that lacks the XTEN.

26. The method of claim 25, wherein the therapeutic effect is a measured parameter selected from HbA1c concentrations, insulin concentrations, stimulated C peptide, fasting plasma glucose (FPG), serum cytokine levels, CRP levels, insulin secretion and Insulin-sensitivity index derived from an oral glucose tolerance test (OGTT), body weight, and food consumption.

27. An isolated fusion protein comprising a glucose regulating peptide, wherein said glucose regulating peptide comprises the amino acid sequence of SEQ ID NO: 4 and wherein said glucose regulating peptide is linked to an extended recombinant polypeptide (XTEN) of at least about 200 amino acids residues, wherein the XTEN is characterized in that:
   (a) the XTEN sequence comprises at least about 200 contiguous amino acids that exhibits at least 90% sequence identity to a comparable length of an amino acid sequence selected from the group consisting of the sequences of SEQ ID NOS: 191-207;
   (b) the XTEN sequence lacks a predicted T-cell epitope when analyzed by TEPITOPE algorithm, wherein the TEPITOPE algorithm prediction for epitopes within the XTEN sequence is based on a score of −9 or greater;
   (c) the XTEN sequence has a subsequence score of less than 10; and
   (d) the sum of glycine (G), alanine (A), serine (S), threonine (T), glutamate (E) and proline (P) residues constitutes more than about 90% of the total number of amino acid residues of the XTEN.

28. The isolated fusion protein of claim 27, wherein the XTEN comprises an amino acid sequence which has at least 90% homology to SEQ ID NO: 199.

29. The isolated fusion protein of claim 27, comprising an amino acid sequence which has at least 90% homology to SEQ ID NO: 896.

30. The isolated fusion protein of claim 27, comprising the amino acid sequence of SEQ ID NO: 896.

* * * * *